ized under 35

(12) United States Patent
Sohn et al.

(10) Patent No.: US 11,919,953 B2
(45) Date of Patent: Mar. 5, 2024

(54) TIGIT AND CD112R BLOCKADE

(71) Applicant: AMGEN INC., Thousand Oaks, CA (US)

(72) Inventors: Sue J. Sohn, Daly City, CA (US); Marissa Mock, Newbury Park, CA (US); Ian Nevin Foltz, Burnaby (CA); Agnieszka Kielczewska, Vancouver (CA); Kathy Manchulenko, Port Coquitlam (CA); Yannick Bulliard, Thousand Oaks, CA (US); Xiaoshan Min, Burlingame, CA (US)

(73) Assignee: AMGEN INC., Thousand Oaks, CA (US)

( * ) Notice: Subject to any disclaimer, the term of this patent is extended or adjusted under 35 U.S.C. 154(b) by 32 days.

(21) Appl. No.: 17/375,958

(22) Filed: Jul. 14, 2021

(65) Prior Publication Data

US 2022/0017616 A1    Jan. 20, 2022

Related U.S. Application Data

(60) Provisional application No. 63/212,315, filed on Jun. 18, 2021, provisional application No. 63/052,011, filed on Jul. 15, 2020.

(51) Int. Cl.
*C07K 16/28* (2006.01)
*A61K 39/00* (2006.01)
*A61P 35/00* (2006.01)

(52) U.S. Cl.
CPC .......... *C07K 16/2803* (2013.01); *A61P 35/00* (2018.01); *C07K 16/2818* (2013.01); *A61K 2039/507* (2013.01); *C07K 2317/21* (2013.01); *C07K 2317/75* (2013.01); *C07K 2317/76* (2013.01); *C07K 2317/92* (2013.01); *C07K 2317/94* (2013.01)

(58) Field of Classification Search
CPC .. C07K 16/2803; C07K 16/2818; A61P 35/00
See application file for complete search history.

(56) References Cited

U.S. PATENT DOCUMENTS

| | | | |
|---|---|---|---|
| 4,450,150 A | 5/1984 | Sidman | |
| 5,449,752 A | 9/1995 | Fujii et al. | |
| 6,114,598 A | 9/2000 | Kucherlapati et al. | |
| 6,162,963 A | 12/2000 | Kucherlapati et al. | |
| 6,303,144 B1 | 10/2001 | Omura | |
| 6,699,843 B2 | 3/2004 | Pietras et al. | |
| 6,833,268 B1 | 12/2004 | Green et al. | |
| 7,049,426 B2 | 5/2006 | Green et al. | |
| 7,064,244 B2 | 6/2006 | Jakobovits et al. | |
| 7,943,743 B2 | 5/2011 | Korman et al. | |
| 9,327,014 B2 | 5/2016 | Gurney et al. | |
| RE46,534 E | 9/2017 | Baldwin et al. | |
| RE46,805 E | 4/2018 | Baldwin et al. | |
| RE46,816 E | 5/2018 | Baldwin et al. | |
| 9,994,637 B2 | 6/2018 | Gao et al. | |
| 10,626,174 B2 | 4/2020 | Grogan et al. | |
| 11,028,172 B1 | 6/2021 | Gong et al. | |
| 2007/0054360 A1 | 3/2007 | Gao et al. | |
| 2014/0178905 A1 | 6/2014 | Walker et al. | |
| 2017/0037127 A1 | 2/2017 | Grogan et al. | |
| 2017/0044256 A1 | 2/2017 | Grogan et al. | |
| 2017/0088613 A1 | 3/2017 | Grogan et al. | |
| 2018/0155422 A1 | 6/2018 | Bhatt et al. | |
| 2018/0169239 A1 | 6/2018 | Grogan | |
| 2018/0371083 A1 | 12/2018 | Williams et al. | |
| 2019/0077869 A1 | 3/2019 | Fiedler et al. | |
| 2019/0119376 A1 | 4/2019 | Grogan et al. | |
| 2020/0040081 A1* | 2/2020 | Prinz .................. | C07K 16/2818 |
| 2020/0255516 A1 | 8/2020 | Fu et al. | |
| 2021/0040201 A1 | 2/2021 | Shi et al. | |
| 2021/0087266 A1 | 3/2021 | Chou et al. | |
| 2022/0162310 A1 | 5/2022 | Park et al. | |
| 2022/0267475 A1 | 8/2022 | Yin et al. | |

(Continued)

FOREIGN PATENT DOCUMENTS

| CN | 111995681 A | 11/2020 |
|---|---|---|
| CN | 111718415 B | 2/2021 |
| CN | 112433055 A | 3/2021 |

(Continued)

OTHER PUBLICATIONS

McCarthy et al., J. Immunol. Methods, 251(1-2): 137-149 (Year: 2001).*
Mariuzza (Annu. Rev. Biophys. Biophys. Chem., 16: 139-159) (Year: 1987).*
Lin et al. (African Journal of Biotechnology, 10(79):18294-18302) (Year: 2011).*
Allison KH, Sledge GW. Heterogeneity and cancer. Oncology (Williston Park). Sep. 2014;28(9):772-8. PMID: 25224475. (Year: 2014).*
Can Cancer be Cured, American Cancer Society, retrieved from: https://www.cancer.org/cancer/understanding-cancer/can-cancer-be-cured.htm (Year: 2023).*

(Continued)

*Primary Examiner* — Gregory S Emch
*Assistant Examiner* — Ashley H. Gao
(74) *Attorney, Agent, or Firm* — Julie J. Hong

(57) ABSTRACT

Provided herein are TIGIT binding proteins, CD112R binding proteins, and combinations thereof. Also provided are compositions comprising TIGIT binding proteins and CD112R binding proteins, optionally further comprising PD-1 binding proteins. Related conjugates, fusion proteins, nucleic acids, vectors, host cells and kits are additionally provided. Further provided are pharmaceutical compositions comprising a TIGIT binding protein, CD112R binding protein, or a combination thereof, optionally, further comprising a PD-1 antigen binding protein, or a conjugate, fusion protein, nucleic acid, vector, or host cell, and a pharmaceutically acceptable carrier, diluent, or excipient, and methods of treating subjects in need thereof.

41 Claims, 74 Drawing Sheets

Specification includes a Sequence Listing.

(56) References Cited

U.S. PATENT DOCUMENTS

2022/0348650 A1   11/2022   Huang et al.

FOREIGN PATENT DOCUMENTS

| | | |
|---|---|---|
| EP | 3021869 B1 | 7/2020 |
| EP | 4089115 A1 | 11/2022 |
| WO | 1987/005330 A1 | 9/1987 |
| WO | 2000/032218 A1 | 6/2000 |
| WO | 2004/033036 A2 | 4/2004 |
| WO | 2006/121168 A1 | 11/2006 |
| WO | 2008/130158 A1 | 10/2008 |
| WO | 2009/126688 A2 | 10/2009 |
| WO | 2013/184912 A2 | 12/2013 |
| WO | 2015/009856 A2 | 1/2015 |
| WO | 2015/112805 A1 | 7/2015 |
| WO | 2015/143343 A2 | 9/2015 |
| WO | 2016/011264 A1 | 1/2016 |
| WO | 2016/028656 A1 | 2/2016 |
| WO | 2016/106302 A1 | 6/2016 |
| WO | 2016/134333 A9 | 8/2016 |
| WO | 2016/134335 A2 | 8/2016 |
| WO | 2017/021526 A1 | 2/2017 |
| WO | 2017/030823 A2 | 2/2017 |
| WO | 2017/037707 A1 | 3/2017 |
| WO | 2017/041004 A1 | 3/2017 |
| WO | 2017/053748 A2 | 3/2017 |
| WO | 2017/152088 A1 | 9/2017 |
| WO | 2018/017864 A2 | 1/2018 |
| WO | 2018/033798 A1 | 2/2018 |
| WO | 2018/102536 A1 | 6/2018 |
| WO | 2018/102746 A1 | 6/2018 |
| WO | 2018/157162 A1 | 8/2018 |
| WO | 2018/160704 A9 | 9/2018 |
| WO | 2018/183889 A1 | 10/2018 |
| WO | 2018/204363 A1 | 11/2018 |
| WO | 2018/204405 A1 | 11/2018 |
| WO | 2018/220446 A1 | 12/2018 |
| WO | 2019/023504 A1 | 1/2019 |
| WO | 2019/129221 A1 | 7/2019 |
| WO | 2019/137548 A1 | 7/2019 |
| WO | 2019/140196 A1 | 7/2019 |
| WO | 2019/152574 A1 | 8/2019 |
| WO | 2019/154415 A1 | 8/2019 |
| WO | 2019/165434 A1 | 8/2019 |
| WO | 2019/168382 A1 | 9/2019 |
| WO | 2019/232484 A9 | 12/2019 |
| WO | 2020/006516 A1 | 1/2020 |
| WO | 2020/018879 A1 | 1/2020 |
| WO | 2020/041541 A9 | 2/2020 |
| WO | 2020/176718 A1 | 9/2020 |
| WO | 2020/176748 A1 | 9/2020 |
| WO | 2020/242919 A1 | 12/2020 |
| WO | 2020/257760 A1 | 12/2020 |
| WO | 2021/021767 A1 | 2/2021 |
| WO | 2021/021837 A2 | 2/2021 |
| WO | 2021/021973 A1 | 2/2021 |
| WO | 2021/061842 A1 | 4/2021 |
| WO | 2021/062085 A1 | 4/2021 |
| WO | 2021/067229 A2 | 4/2021 |
| WO | 2021/089704 A1 | 5/2021 |
| WO | 2021/091605 A1 | 5/2021 |
| WO | 2021/092196 A1 | 5/2021 |
| WO | 2021/092221 A1 | 5/2021 |
| WO | 2021/093849 A1 | 5/2021 |
| WO | 2021/097294 A1 | 5/2021 |
| WO | 2021/098757 A1 | 5/2021 |
| WO | 2021/113831 A1 | 6/2021 |
| WO | 2021/139776 A1 | 7/2021 |
| WO | 2021/139780 A1 | 7/2021 |

OTHER PUBLICATIONS

Wiley, F., Solid Tumors: What Pharmacists Need to Know, Drug Topics, retrieved from: https://www.drugtopics.com/view/solid-tumors-what-pharmacists-need-know (Year: 2019).*

Abhinandan et al., "Analysis and improvements to Kabat and structurally correct numbering of antibody variable domains," *Molecular Immunology* 45: 3832-3839 (2008).

Al-Lazikani et al., "Standard Conformations for the Canonical Structures of Immunoglobulins," *J. Mol. Biol.* 273: 927-948 (1997).

Anonymous, "Guidance for Industry: Codevelopment of Two or More New Investigational Drugs for Use in Combination," U.S. Department of Health and Human Services, Food and Drug Administration, Center for Drug Evaluation and Research (CDER), 16 pages, Jun. 2013.

Aplin and Wriston, "Preparation, Properties, and Applications of Carbohydrate Conjugates of Proteins and Lipids," *CRC Crit. Rev. Biochem.* 10(4): 259-306 (1981).

Arai et al., "Design of the linkers which effectively separate domains of a bifunctional fusion protein," *Protein Engineering* 14(8): 529-532 (2001).

Bercovici et al., "New Methods for Assessing T-Cell Responses," *Clin Diagn Lab Immunol.* 7(6): 859-864 (2000).

Blackburn et al., "Coregulation of $CD8^+T$ cell exhaustion by multiple inhibitory receptors during chronic viral infection," *Nature Immunology* 10(1): 29-37 (2009).

Cao et al., "Charge variants characterization and release assay development for co-formulated antibodies as a combination therapy," *mAbs* 11(3): 489-499 (2019).

Chand et al., "A competitive ELISA for detection of group specific antibody to bluetongue virus using anti-core antibody," *Biologicals* 46: 168-171 (2017).

Chen et al., "Fusion Protein Linkers: Property, Design and Functionality," *Adv Drug Delivery Reviews* 65(10): 1357-1369 (2013).

Chothia and Lesk, "Canonical Structures for the Hypervariable Regions of Immunoglobulins," *J. Mol. Biol.* 196:901-917 (1987).

Chothia et al., "Conformations of immunoglobulin hypervariable regions," *Nature* 342: 877-883 (1989).

Clay et al., "Assays for Monitoring Cellular Immune Responses to Active Immunotherapy of Cancer," *Clin Cancer Res.* 7(5):1127-1135 (2001).

Curran et al., "PD-1 and CTLA-4 combination blockade expands infiltrating T cells and reduces regulatory T and myeloid cells within B16 melanoma tumors," *PNAS* 107(9): 4275-4280 (2010).

Duraiswamy et al., "Dual Blockade of PD-1 and CTLA-4 Combined with Tumor Vaccine Effectively Restores T-Cell Rejection Function in Tumors," *Cancer Research* 73(12): 3591-3603 (2013).

Fourcade et al., "Upregulation of Tim-3 and PD-1 expression in associated with tumor antigen-specific CD8+ T cell dysfunction in melanoma patients," *Journal of Experimental Medicine* 207(10): 2175-2186 (2010).

Frenzel et al., "Expression of recombinant antibodies," *Front. Immunol.* 4: 217 (2013).

Fu et al., "A Simple and Sensitive Method for Measuring Tumor-Specific T Cell Cytotoxicity," *PLoS ONE* 5(7): e11867 (2010).

Gaillet et al., "High-Level Recombinant Protein Production in CHO Cells Using an Adenoviral Vector and the Cumate Gene-Switch," *Biotechnol. Prog.* 23: 200-209 (2007).

Goolia et al., "Validation of a competitive ELISA and a virus neutralization test for the detection and confirmation of antibodies to Senecavirus A in swine sera," *J. Vet. Diagn. Invest.* 29(2): 250-253 (2017).

Green et al., "Antigen-specific human monoclonal antibodies from mice engineered with human Ig heavy and light chain YACs," *Nature Genetics* 7(1):13-21 (1994).

Green and Jakobovits, "Regulation of B Cell Development by Variable Gene Complexity in Mice Reconstituted with Human Immunoglobulin Yeast Artificial Chromosomes," *J. Exp. Med.* 188(3):483-495 (1998).

Honegger and Pluckthun, "Yet Another Numbering Scheme for Immunoglobulin Variable Domains: An Automatic Modeling and Analysis Tool," *J. Mol. Biol.* 309(3): 657-670 (2001).

Hunter and Cochran, "Cell-Binding Assays for Determining the Affinity of Protein-Protein Interactions: Technologies and Considerations," *Methods in Enzymology* 580: 21-44 (2016).

Inozume et al., "Development of a novel immunotherapy for melanoma which inhibits interaction between CD155 on melanoma

(56) References Cited

OTHER PUBLICATIONS cells and TIGIT on activated CTL," *Journal of Investigative Dermatology* 133(75):S3 (2013).
Intlekofer and Thompson, "At the Bench: Preclinical rationale for CTLA-4 and PD-1 blockade as cancer immunotherapy," *Journal of Leukocyte Biology* 94: 25-39 (2013).
Jacobsen et al., "Engineering an IgG Scaffold Lacking Effector Function with Optimized Developability," *J. Biol. Chem.* 292(5): 1865-1875 (2017).
Jin et al., "Cooperation of Tim-3 and PD-1 in CD8 T-cell exhaustion during chronic viral infection," *PNAS* 107(33): 14733-14738 (2010).
Joller et al., "Cutting Edge: TIGIT Has T Cell-Intrinsic Inhibitory Functions," *Journal of Immunology* 186: 1338-1342 (2011).
Joller et al., "Immune Checkpoints in CNS Autoimmunity," *Immunol Rev.* 248(1): 122-139 (2012).
Kellermann and Green, "Antibody discovery: the use of transgenic mice to generate human monoclonal antibodies for therapeutics," *Current Opinion in Biotechnology* 13:593-597 (2002).
Khan, "Gene Expression in Mammalian Cells and its Applications," *Advanced Pharmaceutical Bulletin* 3(2): 257-263 (2013).
Kim et al., "Analytical characterization of coformulated antibodies as combination therapy," *mAbs* 12(1): 1-47 (2020).
Krieg et al., "Overcoming challenges in co-formulation of proteins with excluding stability profiles—EPO plus G-CSF," Colorado Protein Stability Conference: 25th Anniversary, Jul. 29-Aug. 1, 2019, Breckenridge, Colorado, 2019.
Lefranc, "The IMGT Unique Numbering for Immunoglobulins, T-Cell Receptors, and Ig-Like Domains," *The Immunologist* 7(4): 132-136 (1999).
Lefranc et al., "IMGT unique numbering for immunoglobulin and T cell receptor variable domains and Ig superfamily V-like domains," *Dev. Comp. Immunol.* 27(1): 55-77 (2003).
Levin et al., "Vstm3 is a member of the CD28 family and an important modulator of T-cell function," *European Journal of Immunology* 41: 902-915 (2011).
Li et al., "Cell culture processes for monoclonal antibody production" *mAbs* 2(5): 466-479 (2010).
Li et al., "Blockade of checkpoint receptor PVRIG unleashes anti-tumor immunity of NK cells in murine and human solid tumors," *J Hematol Oncol.* 14(1):100 (2021).
Liu et al., "Biological Characterization of a Stable Effector Functionless (SEFL) Monoclonal Antibody Scaffold in Vitro," *J. Biol. Chem.* 292(5): 1876-1883 (2017).
Liu et al., "Development of competitive ELISA for the detection of bovine serum albumin using single-chain variable fragments," *Analytical Biochemistry* 525: 89-91 (2017).
Lozano et al., "The TIGIT/CD226 Axis Regulates Human T Cell Function," *Journal of Immunology* 188: 3869-3875 (2012).
Macatangay et al., "Comparison of Immunologic Assays for Detecting Immune Responses in HIV Immunotherapeutic Studies: AIDS Clinical Trials Group Trial A5181," *Clin. Vaccine Immunol.* 17(9): 1452-1459 (2010).
Matsuzaki et al., "Tumor-infiltrating NY-ESO-1-specific $CD8^+T$ cells are negatively regulated by LAG-3 and PD-1 in human ovarian cancer," *PNAS* 107(17): 7875-7880 (2010).
McDermott et al., "PD-1 as a potential target in cancer therapy," *Cancer Medicine* 2(5): 662-673 (2013).
Mendez et al., "Functional transplant of megabase human immunoglobulin loci recapitulates human antibody response in mice," *Nature Genetics* 15(2):146-156 (1997).
Mosharraf and Nayar, "Coformulation Development of Biologics in Combination Drugs," *AAPS Newsmagazine*, Aug. 2019, pp. 1-20.
Nakamoto et al., "Synergistic Reversal of intrahepatic HCV-Specific CD8 T Cell Exhaustion by Combined PD-1/CTLA-4 Blockade," *PLoS Pathogens* 5(2): e1000313 (2009).
Okazaki et al., "PD-1 and LAG-3 inhibitory co-receptors act synergistically to prevent autoimmunity in mice," *Journal of Experimental Medicine* 208(2): 395-407 (2011).
Panchal, "Biologics Co-Formulation Product Development: Challenges and Case studies," presentation, Merck & Co. Inc., Jan. 2020, 23 pages.
Qian et al., "Sustained release subcutaneous delivery of BMS-686117, a GLP-1 receptor peptide agonist, via a zinc adduct," *Int. J. Pharm.* 374: 46-52 (2009).
Shi et al., "Complete Regression of Xenograft Tumors upon Targeted Delivery of Paclitaxel via II-II Stacking Stabilized Polymeric Micelles," *ACS Nano* 9(4): 3740-3752 (2015).
Shimamoto et al., "Peptibodies: A flexible alternative format to antibodies," *mAbs* 4(5): 586-591 (2012).
Simon et al., "Peptoids: A modular approach to drug discovery," *PNAS USA* 89(20): 9367-9371 (1992).
Smith-Garvin et al., "T Cell Activation," *Annu. Rev. Immunol.* 27: 591-619 (2009).
Spiess et al., "Alternative molecular formats and therapeutic applications for bispecific antibodies," *Molecular Immunology* 67(2 Pt. A): 95-106 (2015).
Stanietsky et al., "The interaction of TIGIT with PVR and PVRL2 inhibits human NK cell cytotoxicity," *PNAS* 106(42): 17858-17863 (2009).
Stanietsky et al., "Mouse TIGIT inhibits NK-cell cytotoxicity upon interaction with PVR," *Eur J Immunol.* 43(8):2138-2150 (2013).
Tam et al., "Abciximab (ReoPro, Chimeric 7E3 Fab) Demonstrates Equivalent Affinity and Functional Blockade of Glycoprotein IIb/IIIa and $\alpha v \beta 3$ Integrins," *Circulation* 98(11): 1085-1091 (1998).
Trikha et al., "CNTO 95, a fully human monoclonal antibody that inhibits $\alpha v$ integrins, has antitumor and antiangiogenic activity in vivo," *Int. J. Cancer* 110(3): 326-335 (2004).
Trujillo, "Role of combination therapy or coformulation products in treatment of type 2 diabetes," *Pharmacy Today* 24(8) :50-62 (2018).
Wriggers et al., "Control of Protein Functional Dynamics by Peptide Linkers," *Biopolymers (Peptide Science)* 80(6): 736-746 (2005).
Zhu et al., "Identification of CD112R as a novel checkpoint for human T cells," *Journal of Experimental Medicine* 213(2): 167-176 (2016).

\* cited by examiner

|  | PL-52575 | PL-52576 | PL-52577 |
|---|---|---|---|
| EC50 (nM) | 0.1822 | 12.73 | 0.05351 |

- ▼ Vector PL-52575
- ◆ Vector PL-52576
- ● Vector PL-52577
- ○ CD112 PL-52575
- ■ CD112 PL-52576
- ▲ CD112 PL-52577
- □ Vector HuIgG
- △ Vector MuIgG
- ▽ CD112 HuIgG
- ◇ CD112 MuIgG

FIG. 5A

Table 1A - Wave 1 - Xenomouse Immunizations

| Campaign and harvest | Strain | Immunogen | huCD112R/293T Ag+ hits, early primary | Functional hits (Jurkat CD112R Reporter) | Recombinant cyCD112R/293T | Primary cy CD112R binders |
|---|---|---|---|---|---|---|
| Harvest 1 | XMG2/XMG4 | DNA | 216 | 216 | 138 | 1 |
| Harvest 2 | XMG2kl | Soluble | 539 | | | 1 |
| Harvest 3 | XMG2/XMG4 | DNA and soluble | 469 | | 136 | 0 |

Cy = cynomolgus monkey; hu=human

FIG. 5B

Table 1B - Wave 2 - CD112R KO and expanded Xenomouse Immunizations

| HUcd112R Hybrid pools | Strain | # animals | Immunogen | huCD112R/293T Ag+ hits, early primary | Functional hits (Jurkat CD112R Reporter) | Recombinant cyCD112R/293T | Primary cy CD112R binders |
|---|---|---|---|---|---|---|---|
| Harvest 6 | XMG2 CD112R KO | 1 | Soluble | 887 | 323 | 86 | 4 |
| Harvest 7 | XMG2kl | 12 | DNA | 308 | 13 | 220 | 23 |
| Harvest 8 | XMG2 CD112R KO | 9 | DNA | 51 | 10 | 18 | 0 |
| Harvest 9 | XMG2 CD112R KO | 3 | Soluble | 59 | 4 | 12 | 0 |

Cy = cynomolgus monkey; hu = human; KO = Knock out

FIG. 7B

| Well ID | CD112R Jurkat RGA | | | Sequence Diversity | |
|---|---|---|---|---|---|
| | EC50 [nM] N=1 | EC50 [nM] N=2 | EC50 [nM] Average | VH Germline | HC CDR3 |
| 1E1 | 3.1 | nd | nd | VH1\|1-02/D5\|5-18\|RF1/JH6 | EDNFN------GMDV |
| 18C10 | 2.9 | 3.0 | 2.9 | VH1\|1-02/D5\|5-18\|RF1/JH6 | EDNFN------GMDV |
| 11E4 | 6.4 | 5.0 | 5.7 | VH4\|4-30.1/D7\|7-27\|RF2/JH6 | DLDYDILTGY------PRWDYGMDV |

| Well ID | CD112R Jurkat RGA | | | Sequence Diversity | |
|---|---|---|---|---|---|
| | EC50 [nM] N=1 | EC50 [nM] N=2 | EC50 [nM] Average | VH Germline | HC CDR3 |
| 27G12 | 4.7 | 5.5 | 5.1 | VH1\|1-08/D5\|5-24\|RF2/JH6 | ERFPF------GMDV |
| 28H7 | 4.9 | 6.8 | 5.9 | VH3\|3-13/D1\|1-1\|RF1/JH6 | EEFGH------GMDV |
| 29E10 | 3.4 | 6.3 | 4.9 | VH3\|3-13/D1\|1-1\|RF1/JH6 | EEFGY------GMDV |
| 28F9 | 6.2 | 7.0 | 6.6 | VH3\|3-13/D1\|1-1\|RF1/JH6 | EEFGN------GMDV |
| 31B3 | 5.5 | 8.2 | 6.9 | VH3\|3-30.3/D3\|3-3\|RF3/JH6 | EIFGESY------YYGMDV |
| 24F1 | 3.4 | 4.8 | 4.1 | VH3\|3-13/D1\|1-1\|RF1/JH4 | EGQVAL------RYGRL |
| 36C8 | 5.8 | 8.1 | 7.0 | VH3\|3-13/D6\|6-19\|RF3/JH6 | EGQWP------YGMDV |

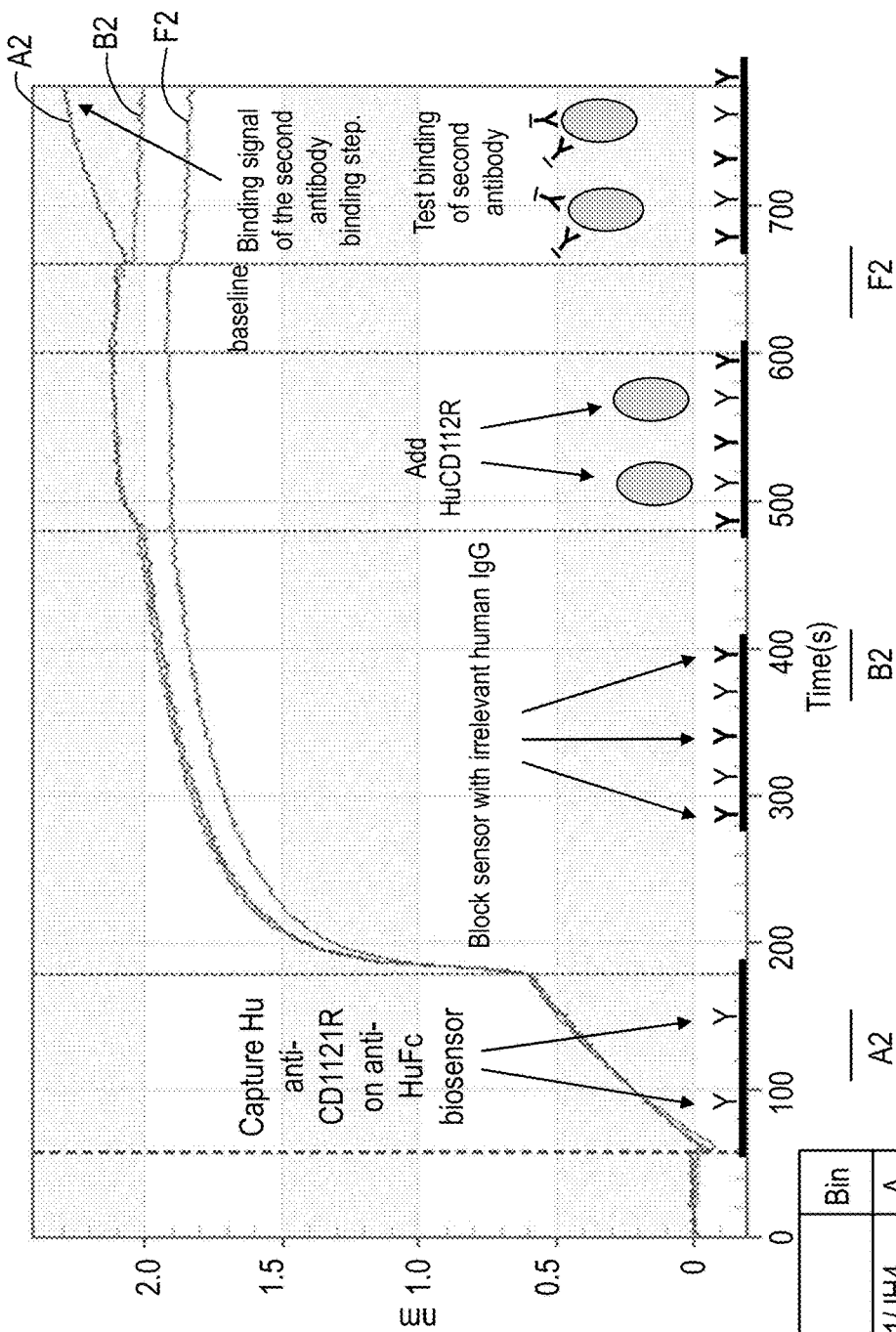

Binding to Cyno PBMCs

Binding to Human T-cells

Potency of CD112R abs

| Antibody | Jurkat RGA Assay Interpolated @ 1.9-fold EC50 (nM) |
|---|---|
| 11E4 | 3.2 |
| 1E1 | 1.3 |
| 27G12 | 1.8 |
| 29E10 | 1.3 |
| 24F1 | 1.3 |
| 31B3 | 3.5 |

- AB1 + Jurkat IL-2luc/TIGIT
- AB2 + Jurkat IL-2luc/TIGIT
- MBSA43 + Jurkat IL-2luc/TIGIT
- AB1 + Jurkat IL-2luc/TIGIT/CD226KO
- AB2 + Jurkat IL-2luc/TIGIT/CD226KO
- MBSA43 + Jurkat IL-2luc/TIGIT/CD226KO

AB1=43B7.002.015
AB2=66H9.010

Triple vs. PD-1+TIGIT

Triple vs. TIGIT+CD112R

Abs:
PD-1=Nivo
TIGIT=43B7.002
CD112R=PL-52577
Assay format: pp65 CMV recall assay

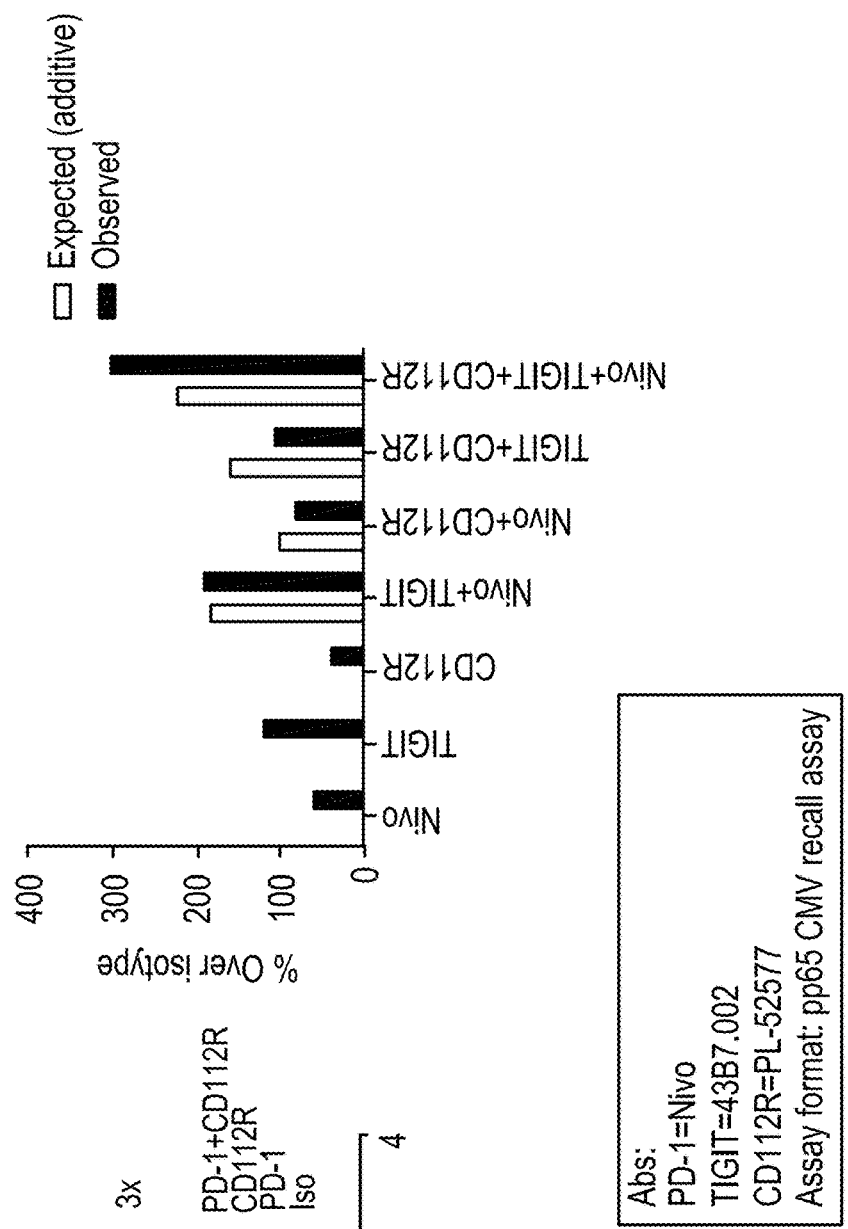
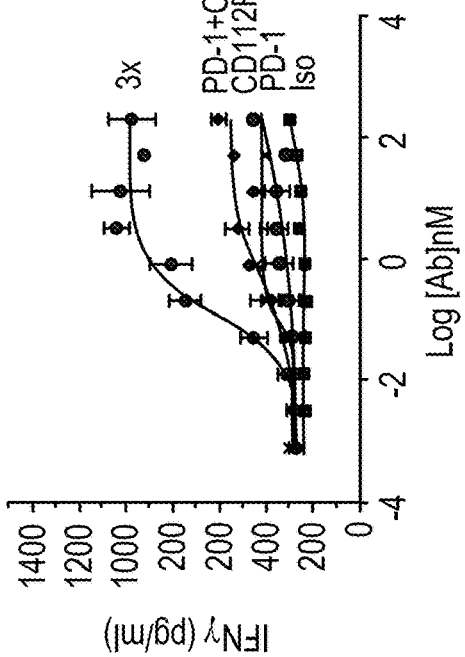

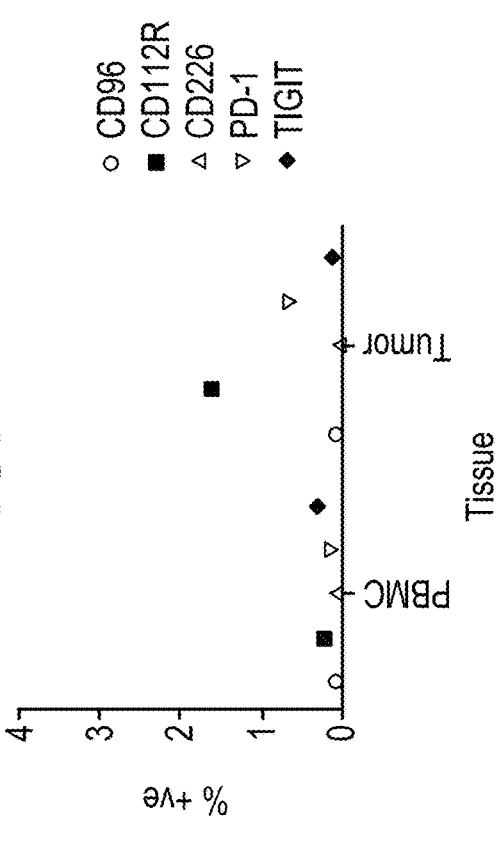
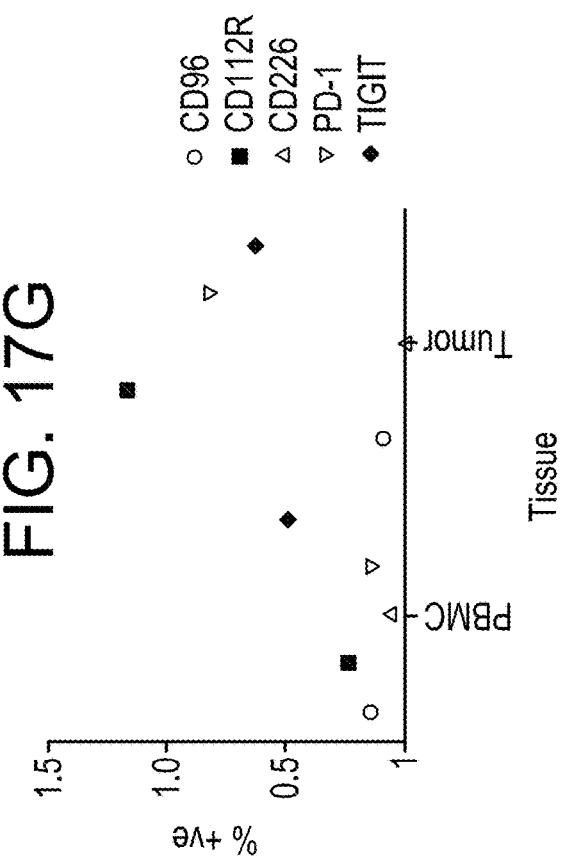
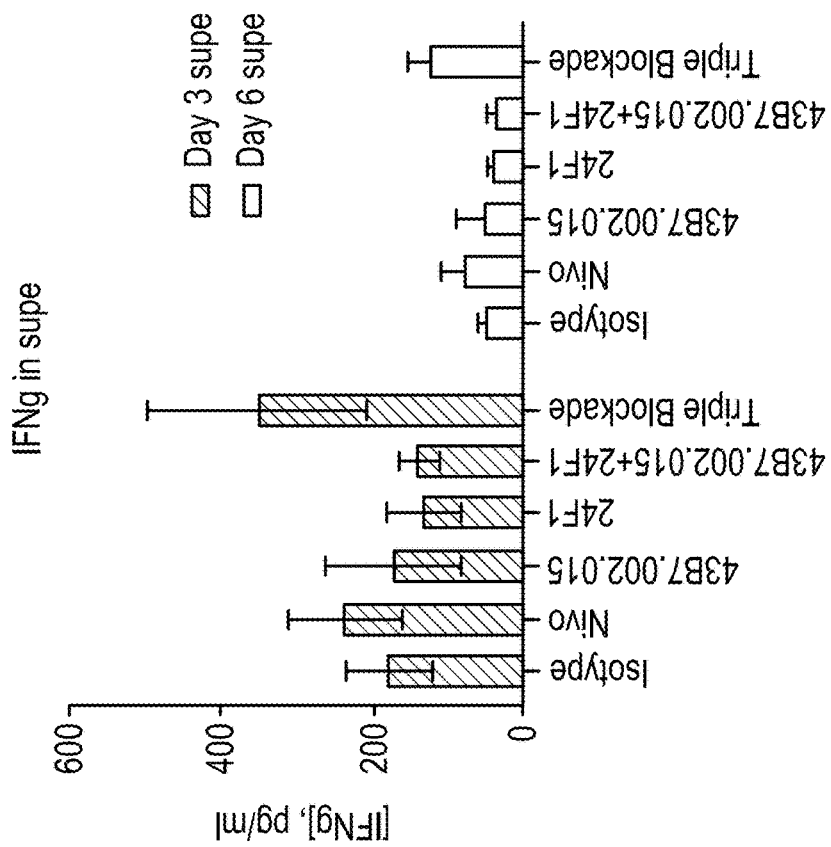

FIGURE 18

Table 2 CD112R Hotspot Engineering

| mAbs | Initial IgG Ave Titer1 ECSO (nM) | Titer (mg/L) | Recovery (mg/L) | % Recovery | MS IEX HIC HMW (%) | Tm1 (°C) | Tagg (°C) |
|---|---|---|---|---|---|---|---|
| 1E1 | 1.11 | 557 | 546 | 9 | 95.6 | 71.1 | 71.7 |
| 1E1.001 | 1.18 | 682 | 538 | 9 | 93.4 | 69.3 | 70.2 |
| 1E1.002 | 1.12 | 1084 | 569 | 8 | 93.9 | 69.3 | 70.1 |
| 1E1.003 | 1.47 | 1600 | 554 | 10 | 93.2 | 70.6 | 71.2 |
| 1E1.004 | 1.16 | 1010 | 577 | 9 | 94.3 | nd | nd |
| 1E1.005 | 1.00 | 987 | 562 | 8 | 95 | 69.8 | 70.4 |
| 1E1.006 | 1.13 | 886 | 538 | 7 | 94.6 | 69 | 70.4 |
| 1E1.007 | 1.51 | 1186 | 562 | 8 | 95.7 | 71 | 71.4 |
| 1E1.008 | 1.17 | 608 | 515 | 8 | 95.4 | 71.1 | 71.7 |
| 1E1.009 | 1.34 | 453 | 500 | 7 | 97 | 66.6 | 67.9 |
| 1E1.010 | 1.57 | 1154 | 554 | 7 | 96.3 | 66.7 | 67.8 |
| 1E1.011 | 1.88 | 1237 | 508 | 7 | 97.5 | 67.6 | 68.3 |
| 1E1.012 | 1.14 | 1139 | 462 | 6 | 97.1 | 67.8 | 67.4 |
| 1E1.013 | 0.92 | 987 | 562 | 7 | 94.6 | 67.5 | 68.5 |
| 1E1.014 | 1.04 | 1158 | 531 | 7 | 95.7 | 67.6 | 68.5 |
| 1E1.015 | 1.33 | 581 | 531 | 8 | 95.1 | 68.5 | 69.3 |
| 1E1.016 | 0.98 | 676 | 531 | 7 | 95.4 | 68.6 | 69.4 |
| 1E1.017 | 2.01 | 523 | 538 | 8 | 94.8 | 69.1 | 70 |
| 1E1.018 | 1.40 | 521 | 400 | 6 | 96.6 | 69 | 70.2 |
| 1E1.019 | 4.97 | 1355 | 554 | 9 | 95.1 | 70.2 | 70.9 |
| 1E1.020 | 1.55 | 573 | 546 | 9 | 95.1 | 70.3 | 70.9 |
| 1E1.021 | 1.99 | 555 | 523 | 7 | 96.4 | 69.5 | 70.3 |
| 1E1.022 | 1.43 | 398 | 308 | 5 | 94.9 | 69.5 | 70.5 |
| 1E1.023 | 7.23 | 535 | 531 | 8 | 95.4 | 70.8 | 71.4 |
| 1E1.024 | 1.61 | 606 | 569 | 8 | 97 | 70.8 | 71.6 |
| 1E1.025 | 2.00 | 514 | 492 | 5 | 96.7 | 66.2 | 67.8 |
| 1E1.026 | 1.56 | 512 | 546 | 5 | 97 | 66.2 | 67.4 |
| 1E1.027 | 4.52 | 515 | 485 | 4 | 97.5 | 67.1 | 68.2 |
| 1E1.028 | 1.96 | 675 | 492 | 4 | 97.4 | 67.2 | 68.3 |
| 1E1.029 | 2.39 | 636 | 538 | 5 | 96.3 | 67.1 | 68.2 |
| 1E1.030 | 1.80 | 531 | 500 | 6 | 97.5 | 67.3 | 68.4 |
| 1E1.031 | 6.22 | 789 | 515 | 5 | 98.2 | 68.1 | 69.1 |
| 1E1.032 | 2.07 | 611 | 531 | 5 | 98.1 | 68.2 | 69.2 |
| 1E1.049 | 5.21 | 850 | 600 | 8 | 97.9 | 72.4 | 72.7 |
| 1E1.050 | 7.27 | 1005 | 577 | 8 | 97.8 | 71.7 | 71.9 |
| 1E1.052 | 0.97 | 954 | 562 | 10 | 93.6 | 71.8 | 72.4 |
| 1E1.055 | 2.13 | 545 | 531 | 7 | 94.8 | 70.1 | 70.8 |
| 1E1.056 | 1.45 | 1038 | 562 | 8 | 95.8 | 71.3 | 72 |

FIGURE 18 (continued)

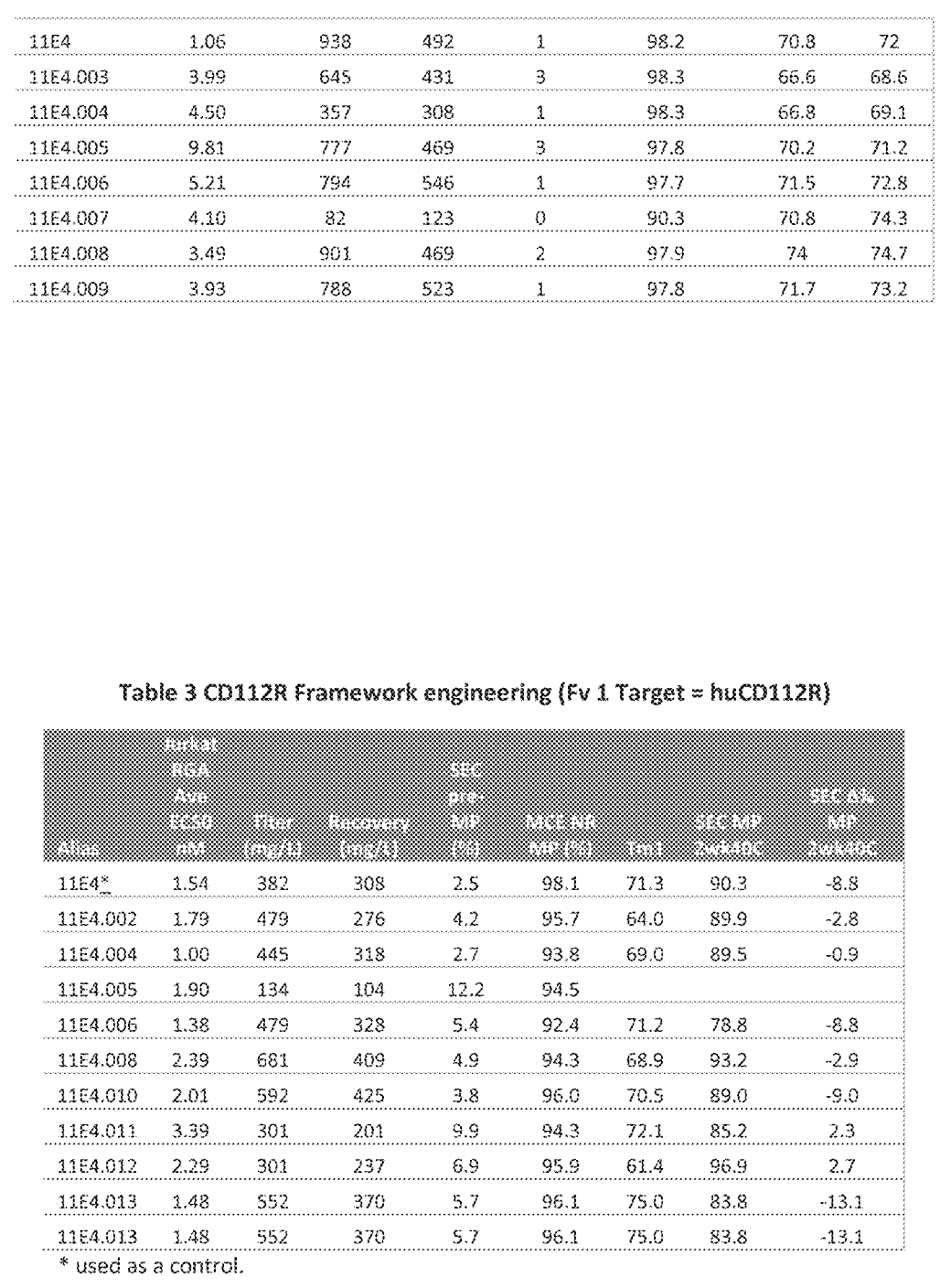

| | | | | | | | |
|---|---|---|---|---|---|---|---|
| 11E4 | 1.06 | 938 | 492 | 1 | 98.2 | 70.8 | 72 |
| 11E4.003 | 3.99 | 645 | 431 | 3 | 98.3 | 66.6 | 68.6 |
| 11E4.004 | 4.50 | 357 | 308 | 1 | 98.3 | 66.8 | 69.1 |
| 11E4.005 | 9.81 | 777 | 469 | 3 | 97.8 | 70.2 | 71.2 |
| 11E4.006 | 5.21 | 794 | 546 | 1 | 97.7 | 71.5 | 72.8 |
| 11E4.007 | 4.10 | 82 | 123 | 0 | 90.3 | 70.8 | 74.3 |
| 11E4.008 | 3.49 | 901 | 469 | 2 | 97.9 | 74 | 74.7 |
| 11E4.009 | 3.93 | 788 | 523 | 1 | 97.8 | 71.7 | 73.2 |

Table 3 CD112R Framework engineering (Fv 1 Target = huCD112R)

| Ab | Initial RGA Avg EC50 (nM) | Titer (mg/L) | Recovery (mg/L) | SEC BP HMW (%) | SEC MP MP(%) | SEC LMW (%) | HIC MP 25°C 2weeks | HIC MP 25°C-0weeks |
|---|---|---|---|---|---|---|---|---|
| 11E4* | 1.54 | 382 | 308 | 2.5 | 98.1 | 71.3 | 90.3 | -8.8 |
| 11E4.002 | 1.79 | 479 | 276 | 4.2 | 95.7 | 64.0 | 89.9 | -2.8 |
| 11E4.004 | 1.00 | 445 | 318 | 2.7 | 93.8 | 69.0 | 89.5 | -0.9 |
| 11E4.005 | 1.90 | 134 | 104 | 12.2 | 94.5 | | | |
| 11E4.006 | 1.38 | 479 | 328 | 5.4 | 92.4 | 71.2 | 78.8 | -8.8 |
| 11E4.008 | 2.39 | 681 | 409 | 4.9 | 94.3 | 68.9 | 93.2 | -2.9 |
| 11E4.010 | 2.01 | 592 | 425 | 3.8 | 96.0 | 70.5 | 89.0 | -9.0 |
| 11E4.011 | 3.39 | 301 | 201 | 9.9 | 94.3 | 72.1 | 85.2 | 2.3 |
| 11E4.012 | 2.29 | 301 | 237 | 6.9 | 95.9 | 61.4 | 96.9 | 2.7 |
| 11E4.013 | 1.48 | 552 | 370 | 5.7 | 96.1 | 75.0 | 83.8 | -13.1 |
| 11E4.013 | 1.48 | 552 | 370 | 5.7 | 96.1 | 75.0 | 83.8 | -13.1 |

* used as a control.

FIGURE 18 (continued)

Table 4 CD112R Yeast Display Engineering 1

| Abs | CD112R MFFH RGA (nM) EC50 (nM) | Recovery (mg/L) | SEC HMW (%) | SEC MM (%) | HIC MM (%) | HT DS DSC Tm1 (°C) | HT HS CD Tm (°C) | HT HS DSF Tonset (°C) |
|---|---|---|---|---|---|---|---|---|
| 24F1_CONS | 1.90 | 338.6 | 3.92 | 96.08 | 89.50 | 70 | 90.39 | 88.2 |
| 29E10_CONS | 3.09 | 342.9 | 1.43 | 96.33 | 98.70 | 65.8 | 96.63 | 93.94 |
| 24F1_CONS.001 | 2.09 | 334.3 | 5.5 | 94.5 | 97.31 | 70.6 | 90.83 | 88.66 |
| 24F1_CONS.002 | 2.93 | 334.3 | 5.8 | 94.2 | 97.59 | 69.7 | 92.75 | 90.92 |
| 24F1_CONS.003 | 2.86 | 342.9 | 4.77 | 95.23 | 92.92 | 65.6 | 91.49 | 89.51 |
| 24F1_CONS.004 | 1.97 | 312.9 | 4.07 | 95.93 | 97.55 | 64.4 | 93.93 | 92.38 |
| 24F1_CONS.005 | 2.11 | 334.3 | 3.52 | 96.48 | 96.58 | 63.6 | 94.4 | 92.76 |
| 24F1_CONS.006 | 2.04 | 338.6 | 3.55 | 96.45 | 97.42 | 63.6 | 94.29 | 92.97 |
| 24F1_CONS.007 | 2.19 | 317.1 | 2.63 | 97.37 | 97.55 | 64.4 | 95.63 | 93.83 |
| 24F1_CONS.008 | 2.07 | 347.1 | 7.77 | 92.23 | 97.47 | 68.6 | 89.7 | 88.41 |
| 24F1_CONS.009 | 2.27 | 304.3 | 10.63 | 89.37 | 97.45 | 68.6 | 87.19 | 86.2 |
| 24F1_CONS.011 | 2.13 | 338.6 | 9.06 | 90.94 | 97.53 | 68.9 | 88.72 | 87.32 |
| 24F1_CONS.012 | 2.66 | 355.7 | 8.13 | 91.87 | 97.34 | 68.6 | 90.14 | 88.75 |
| 24F1_CONS.013 | 2.79 | 325.7 | 5.99 | 94.01 | 97.52 | 71.9 | 91.76 | 89.84 |
| 24F1_CONS.014 | 2.36 | 334.3 | 5.73 | 94.27 | 97.55 | 66.3 | 92.25 | 90.86 |
| 24F1_CONS.015 | 2.62 | 334.3 | 7.88 | 92.12 | 97.46 | 71.3 | 90.21 | 88.75 |
| 24F1_CONS.016 | 2.31 | 338.6 | 4.54 | 95.46 | 97.53 | 69.2 | 93.69 | 91.74 |
| 24F1_CONS.017 | 1.95 | 304.3 | 1.8 | 98.2 | 97.44 | 62.2 | 96.68 | 93.81 |
| 24F1_CONS.018 | 2.44 | 308.6 | 6.62 | 93.38 | 97.53 | 69.7 | 91.74 | 89.28 |
| 24F1_CONS.019 | 3.08 | 334.3 | 8.98 | 91.02 | 97.44 | 70.8 | 88.99 | 87.57 |
| 24F1_CONS.020 | 2.65 | 308.6 | 3.85 | 96.15 | 97.53 | 64.1 | 94.46 | 92.6 |
| 24F1_CONS.021 | 2.16 | 321.4 | 4.42 | 95.58 | 97.61 | 69.7 | 93.33 | 91.81 |
| 24F1_CONS.022 | 1.85 | 342.9 | 1.97 | 98.03 | 97.46 | 62.1 | 96.29 | 94.05 |
| 24F1_CONS.023 | 1.73 | 167.1 | 2.31 | 97.69 | 98.07 | 61 | 96.46 | 94.09 |
| 24F1_CONS.024 | 2.12 | 282.9 | 4.09 | 95.91 | 97.00 | 70.5 | 92.73 | 90.9 |
| 24F1_CONS.025 | 2.19 | 351.4 | 4.09 | 95.91 | 97.16 |  | 94.51 | 92.33 |
| 24F1_CONS.026 | 2.42 | 325.7 | 5.81 | 94.19 | 97.40 | 70.7 | 93.01 | 90.99 |
| 24F1_CONS.027 | 2.38 | 338.6 | 4.61 | 95.39 | 94.89 | 69.1 | 93.88 | 91.85 |
| 24F1_CONS.028 | 2.46 | 330.0 | 10.94 | 89.06 | 97.41 | 69.2 | 86.84 | 85.39 |
| 24F1_CONS.029 | 2.61 | 330.0 | 5.56 | 94.44 | 97.17 | 64.6 | 92.63 | 90.81 |
| 24F1_CONS.031 | 2.97 | 325.7 | 4.76 | 95.24 | 97.28 | 61.6 | 93.81 | 91.89 |
| 24F1_CONS.032 | 2.55 | 308.6 | 5.78 | 94.22 | 97.54 | 61.6 | 92.55 | 90.8 |
| 24F1_CONS.033 | 2.67 | 317.1 | 4.97 | 95.03 | 97.50 | 63.2 | 93.61 | 91.71 |
| 24F1_CONS.034 | 2.70 | 248.6 | 6.78 | 93.22 | 97.06 | 67.2 | 89.52 | 87.71 |
| 24F1_CONS.035 | 2.46 | 231.4 | 8.29 | 91.71 | 97.48 | 67.9 | 87.98 | 87.65 |
| 24F1_CONS.036 | 2.64 | 257.1 | 9.5 | 90.5 | 97.33 | 69.2 | 87.23 | 86.18 |
| 24F1_CONS.037 | 3.39 | 278.6 | 11.77 | 88.23 | 97.52 | 68.4 | 85.13 | 84.13 |

FIGURE 18 (continued)

| | | | | | | | | |
|---|---|---|---|---|---|---|---|---|
| 24F1_CONS.038 | 2.52 | 334.3 | 3.01 | 96.99 | 97.78 | 61.2 | 95.29 | 93.08 |
| 24F1_CONS.039 | 2.43 | 347.1 | 4.95 | 95.05 | 75.43 | 59.9 | 93.32 | 91.28 |
| 24F1_CONS.040 | 2.93 | 154.3 | 4.93 | 95.07 | 97.99 | 57.2 | 93.16 | 90.75 |
| 24F1_CONS.041 | 2.73 | 137.1 | 6.13 | 93.87 | 97.76 | 56.4 | 91.76 | 89 |
| 24F1_CONS.042 | 2.66 | 287.1 | 5.9 | 94.1 | 97.63 | 60.7 | 92.62 | 90.35 |
| 24F1_CONS.043 | 2.64 | 291.4 | 6.08 | 93.92 | 97.65 | 61.2 | 91.7 | 90.18 |
| 24F1_CONS.044 | 2.30 | 287.1 | 4.31 | 95.69 | 97.28 | 63.4 | 93.15 | 91.41 |
| 24F1_CONS.045 | 2.18 | 227.1 | 2.57 | 97.43 | 98.08 | 57.3 | 95.19 | 93.15 |
| 24F1_CONS.046 | 1.84 | 321.4 | 3.47 | 96.53 | 97.21 | 62.2 | 94.42 | 92.39 |
| 24F1_CONS.048 | 2.54 | 150.0 | 2.95 | 96.24 | 99.29 | 67.1 | 93.76 | 91.62 |
| 24F1_CONS.049 | 3.00 | 295.7 | 4.08 | 93.27 | 99.18 | 65.4 | 92.95 | 91.17 |
| 24F1_CONS.050 | 2.95 | 141.4 | 3.29 | 95.89 | 98.83 | 64.3 | 92.46 | 90.69 |
| 11E4.009* | 4.06 | 351.4 | 3.39 | 96.61 | 97.01 | 71.5 | 95.09 | 93.25 |
| 11E4.084 | 8.33 | 330.0 | 3.78 | 91.59 | 97.28 | 72.7 | 91.88 | 88.93 |
| 11E4.007* | 2.94 | 390.0 | 3.6 | 96.4 | 96.92 | 71.1 | 94.48 | 95.93 |
| 11E4.087 | 2.35 | 325.7 | 4.44 | 95.56 | 97.12 | 69.9 | 90.43 | 84.7 |
| 11E4.088 | 3.72 | 312.9 | 3.98 | 96.02 | 97.26 | 69.3 | 95.17 | 95.14 |
| 11E4.089 | 2.00 | 325.7 | 2.45 | 97.55 | 97.26 | 71.1 | 88.76 | 87.54 |
| 11E4.090 | 2.31 | 360.0 | 4.92 | 95.08 | 97.25 | 67 | 86.83 | 84.97 |
| 11E4.091 | 2.29 | 372.9 | 6 | 94 | 97.19 | 69.7 | 90.01 | 88.21 |
| 11E4.093 | 2.56 | 325.7 | 8.21 | 91.79 | 96.98 | 68.5 | 89.76 | 85.43 |
| 11E4.094 | 2.63 | 338.6 | 6.15 | 93.85 | 97.56 | 70.8 | 88.19 | 85.58 |
| 11E4.095 | 1.69 | 381.4 | 4.05 | 95.95 | 97.29 | 70.7 | 89.93 | 90.26 |
| 11E4.096 | 2.30 | 407.1 | 4.74 | 95.26 | 97.00 | 68.5 | 91.3 | 89.09 |
| 11E4.097 | 2.69 | 351.4 | 8.55 | 91.45 | 97.02 | 68.5 | 89.23 | 84.18 |
| 11E4.098 | 2.61 | 351.4 | 4.24 | 95.76 | 97.11 | 72.2 | 88.77 | 88.92 |
| 11E4.099 | 2.93 | 398.6 | 3.49 | 96.51 | 97.29 | 69 | 87.15 | 86.2 |
| 11E4.100 | 2.95 | 342.9 | 4.87 | 95.13 | 97.33 | 66 | 86.67 | 88.17 |
| 11E4.102 | 3.20 | 377.1 | 4.98 | 95.02 | 97.30 | 64.7 | 88.99 | 88.67 |
| 11E4.103 | 2.97 | 355.7 | 4.96 | 95.04 | 97.25 | 68.3 | 90.24 | 89.22 |
| 11E4.104 | 2.39 | 364.3 | 5.52 | 94.48 | 97.40 | 72 | 86.9 | 85.32 |
| 11E4.105 | 3.54 | 415.7 | 4.68 | 95.32 | 97.16 | 74.3 | 89.78 | 89.99 |
| 11E4.106 | 2.31 | 381.4 | 5.48 | 94.52 | 97.08 | 71.1 | 90.6 | 87.69 |
| 11E4.107 | 1.93 | 351.4 | 6.75 | 93.25 | 97.07 | 66.7 | 90.86 | 38.39 |
| 11E4.110 | 2.95 | 402.9 | 7.08 | 92.92 | 97.49 | 70.2 | 90.45 | 86.52 |
| 11E4.111 | 2.93 | 342.9 | 5.7 | 94.3 | 97.39 | 72.2 | 89.39 | 84.78 |
| 11E4.112 | 7.14 | 450.0 | 3.99 | 96.01 | 96.89 | 73.7 | 92.6 | 90.43 |
| 11E4.114 | 3.84 | 360.0 | 8.96 | 91.04 | 97.04 | 70.8 | 89.15 | 86.44 |
| 11E4.115 | 3.46 | 355.7 | 9.73 | 90.27 | 96.83 | 68.7 | 86.41 | 82.07 |
| 11E4.116 | 2.90 | 390.0 | 6.98 | 93.02 | 97.03 | 72.9 | 90.97 | 89.4 |
| 11E4.117 | 2.89 | 390.0 | 4.79 | 95.21 | 97.15 | 72 | 91.54 | 89.55 |
| 11E4.118 | 3.52 | 347.1 | 7.93 | 92.07 | 96.94 | 68.9 | 86.78 | 85.92 |
| 11E4.119 | 4.84 | 402.9 | 3.06 | 96.94 | 97.09 | 74.5 | 95.33 | 96.38 |

FIGURE 18 (continued)

| | | | | | | | | |
|---|---|---|---|---|---|---|---|---|
| 11E4.121 | 3.74 | 372.9 | 4.26 | 95.74 | 97.04 | 73.7 | 95.48 | 93.24 |
| 11E4.127 | 6.28 | 385.7 | 3.57 | 96.43 | 97.29 | 72.6 | 95.6 | 96.29 |
| 31B3_S_CONS.147 | 6.40 | 325.7 | 0.37 | 99.63 | 98.04 | 71.4 | 98.58 | 97.1 |
| 31B3_S_CONS.158 | 9.88 | 304.3 | 0.34 | 99.66 | 97.76 | 71.7 | 98.37 | 96.02 |
| 29E10_CONS.001 | 3.12 | 325.7 | 1.51 | 96.39 | 98.58 | 63.8 | 96.58 | 94.03 |
| 29E10_CONS.002 | 2.74 | 342.9 | 1.57 | 96.38 | 98.65 | 64.9 | 96.73 | 94.31 |
| 29E10_CONS.003 | 2.58 | 282.9 | 1.92 | 98.08 | 98.87 | 66 | 96.1 | 93.51 |
| 29E10_CONS.004 | 2.91 | 274.3 | 1.44 | 98.56 | 99.37 | 64.4 | 96.48 | 93.98 |
| 29E10_CONS.005 | 3.40 | 355.7 | 1.14 | 98.86 | 99.35 | 63.1 | 97.36 | 94.96 |
| 29E10_CONS.006 | 2.30 | 317.1 | 1.27 | 98.73 | 99.40 | 64.2 | 97.07 | 94.64 |
| 29E10_CONS.007 | 2.06 | 282.9 | 0.92 | 99.08 | 99.37 | 64.1 | 97.4 | 94.9 |
| 29E10_CONS.008 | 1.80 | 347.1 | 1.16 | 98.84 | 98.82 | 66.5 | 97.14 | 94.6 |
| 29E10_CONS.009 | 3.05 | 12.9 | 0 | 0 | 0.00 | | | |
| 29E10_CONS.011 | 2.63 | 291.4 | 1.31 | 96.04 | 99.45 | 64.4 | 96.45 | 93.77 |
| 29E10_CONS.012 | 3.19 | 342.9 | 1.91 | 95.35 | 98.50 | 64.8 | 95.54 | 93.28 |
| 29E10_CONS.013 | 5.43 | 308.6 | 3.61 | 93.82 | 98.88 | 64.5 | 93.83 | 92.21 |
| 29E10_CONS.014 | 3.32 | 338.6 | 3.72 | 93.68 | 98.73 | 65.8 | 93.67 | 92.58 |
| 29E10_CONS.015 | 3.30 | 308.6 | 2.67 | 94.8 | 99.27 | 67.9 | 95.02 | 93.16 |
| 29E10_CONS.016 | 2.88 | 304.3 | 1.44 | 95.9 | 98.60 | 67.2 | 96.54 | 93.95 |
| 29E10_CONS.017 | 2.88 | 407.1 | 1.36 | 96.33 | 98.88 | 64.7 | 96.66 | 94.04 |
| 29E10_CONS.018 | 2.30 | 407.1 | 1.33 | 96.35 | 98.80 | 64.2 | 96.75 | 94.11 |
| 29E10_CONS.019 | 1.95 | 437.1 | 1.34 | 96.41 | 98.94 | 65.6 | 96.77 | 94.13 |
| 29E10_CONS.020 | 2.04 | 338.6 | 3.55 | 94.06 | 99.42 | 65.3 | 93.94 | 92.43 |
| 29E10_CONS.021 | 2.34 | 355.7 | 4.09 | 93.58 | 99.40 | 55.9 | 94.06 | 92.49 |
| 29E10_CONS.022 | 2.78 | 300.0 | 4.33 | 93.21 | 99.39 | 61.4 | 93.15 | 91.53 |
| 29E10_CONS.023 | 2.90 | 291.4 | 3 | 94.64 | 99.28 | 55.1 | 95.07 | 92.63 |
| 29E10_CONS.024 | 1.49 | 300.0 | 3.89 | 93.55 | 99.34 | 66 | 93.75 | 92.33 |
| 29E10_CONS.025 | 2.86 | 295.7 | 3.28 | 94.21 | 98.50 | 66.9 | 94.43 | 92.66 |
| 29E10_CONS.026 | 3.12 | 304.3 | 3.44 | 94.23 | 98.80 | 66 | 93.87 | 92.96 |
| 29E10_CONS.027 | 2.77 | 338.6 | 1.06 | 96.49 | 98.67 | 66.6 | 96.86 | 94.19 |
| 29E10_CONS.028 | 2.92 | 274.3 | 2.31 | 94.2 | 99.96 | 65.3 | 95.33 | 93.4 |
| 29E10_CONS.029 | 2.72 | 287.1 | 2.3 | 94.14 | 99.61 | 66 | 95.55 | 93.82 |
| 29E10_CONS.030 | 2.97 | 325.7 | 2.2 | 95.53 | 99.39 | 64.9 | 96.04 | 93.47 |
| 29E10_CONS.031 | 2.01 | 334.3 | 2.46 | 95.37 | 99.41 | 49.7 | 95.74 | 94.14 |
| 29E10_CONS.032 | 2.22 | 261.4 | 2.02 | 96.19 | 99.46 | 65.3 | 96.38 | 93.73 |
| 29E10_CONS.033 | 2.52 | 300.0 | 1.59 | 96.52 | 99.59 | | 96.47 | 93.97 |
| 29E10_CONS.034 | 3.04 | 287.1 | 0.9 | 97.32 | 99.34 | | 97.47 | 95.01 |
| 29E10_CONS.035 | 2.52 | 304.3 | 2.83 | 95.5 | 99.36 | 65.1 | 95.06 | 93 |
| 29E10_CONS.036 | 3.06 | 287.1 | 3.04 | 95.15 | 99.42 | 66.1 | 94.89 | 92.95 |
| 29E10_CONS.038 | 4.66 | 342.9 | 2.85 | 95.18 | 99.36 | 66.1 | 95.53 | 93.58 |
| 29E10_CONS.039 | 9.52 | 291.4 | 3.83 | 94.15 | 99.45 | 65.1 | 94.46 | 92.3 |
| 29E10_CONS.040 | 8.31 | 287.1 | 3.04 | 95.28 | 99.42 | 63.9 | 95.35 | 93.05 |
| 29E10_CONS.042 | 2.19 | 304.3 | 3.11 | 95.13 | 98.72 | 65.9 | 95.03 | 93.07 |

FIGURE 18 (continued)

| | | | | | | | | |
|---|---|---|---|---|---|---|---|---|
| 29E10_CONS.043 | 1.99 | 278.6 | 2.6 | 95.59 | 99.38 | 63 | 95.89 | 93.69 |
| 29E10_CONS.044 | 2.91 | 317.1 | 2.33 | 95.97 | 99.29 | 62.2 | 96.09 | 93.83 |
| 29E10_CONS.045 | 2.33 | 347.1 | 2.73 | 95.4 | 98.83 | 62.6 | 95.85 | 93.85 |
| 29E10_CONS.046 | 3.24 | 291.4 | 2.12 | 96.22 | 99.48 | 64.8 | 96.5 | 93.94 |
| 29E10_CONS.047 | 2.97 | 274.3 | 2.11 | 96.47 | 99.32 | 66.4 | 96.33 | 94.07 |
| 29E10_CONS.048 | 3.46 | 287.1 | 1 | 96.99 | 99.30 | 64.4 | 97.58 | 94.94 |
| 29E10_CONS.049 | 3.49 | 321.4 | 2.52 | 95.52 | 99.33 | 61.5 | 95.67 | 93.86 |
| 29E10_CONS.050 | 3.28 | 265.7 | 4.18 | 93.31 | 99.75 | 67.7 | 92.93 | 91.42 |
| 29E10_CONS.051 | 3.34 | 282.9 | 2.93 | 95.56 | 99.15 | 66.3 | 95.21 | 92.83 |
| 29E10_CONS.052 | 3.35 | 270.0 | 3.75 | 94.37 | 99.27 | 65.4 | 93.71 | 92.35 |
| 29E10_CONS.053 | 3.36 | 321.4 | 3.68 | 87.67 | 99.40 | 67.3 | 88.61 | 86.42 |
| 29E10_CONS.054 | 2.60 | 282.9 | 4.26 | 93.81 | 99.78 | 65.2 | 93.4 | 93.17 |
| 29E10_CONS.055 | 2.29 | 240.0 | 4.56 | 90.82 | 99.91 | 67.4 | 90.73 | 88.91 |
| 29E10_CONS.056 | 2.63 | 342.9 | 3.27 | 85.79 | 99.91 | 64.8 | 88.33 | 86.29 |
| 29E10_CONS.057 | 3.69 | 304.3 | 3.62 | 93.11 | 99.87 | 64.1 | 92.95 | 92.25 |
| 29E10_CONS.058 | 3.02 | 338.6 | 3.54 | 88.27 | 99.92 | 64.3 | 88.73 | 87.77 |
| 29E10_CONS.059 | 2.94 | 295.7 | 3.91 | 93.14 | 99.84 | 66.7 | 92.72 | 91.7 |

* used as a control

FIGURE 18 (continued)

Table 5 CD112R Yeast Display Engineering 2

| AB | CD112R-CHO-FcGA EC50 (nM) | EC75 (nM/mL) | %CMax %CD112R-CHO | %CD226-CD112R-CHO |
|---|---|---|---|---|
| 1E1.016* | 0.26 | 6.4 | 88.36 | 99.09 |
| 1E1.016.002 | 0.85 | 7.9 | 86.7 | 98.48 |
| 1E1.016.004 | 0.38 | nd | nd | 98.51 |
| 1E1.016.005 | 0.30 | 7.4 | 85.69 | 98.85 |
| 1E1.016.007 | 0.37 | 9.2 | 83.9 | 98.79 |
| 1E1.016.008 | 0.26 | 8.4 | 83.59 | 98.74 |
| 1E1.016.009 | 2.56 | nd | nd | 97.67 |
| 1E1.016.010 | 1.06 | 8 | 87.15 | 98.78 |
| 1E1.016.012 | 0.39 | 1 | 97.15 | 99.06 |
| 1E1.016.013 | 0.34 | 7.7 | 85.7 | 98.83 |
| 1E1.016.014 | 0.37 | nd | nd | 98.84 |
| 1E1.016.015 | 0.44 | 9.1 | 84.56 | 99.01 |
| 1E1.016.016 | 0.30 | 8.3 | 84.3 | 98.95 |
| 1E1.016.018 | 0.47 | 8.6 | 84.96 | 98.71 |
| 1E1.016.020 | 0.50 | nd | nd | 96.45 |
| 1E1.016.021 | 0.30 | 7.8 | 85.31 | 98.96 |
| 1E1.016.023 | 0.38 | 8.6 | 84.03 | 98.93 |
| 1E1.016.024 | 0.26 | 8.3 | 83.93 | 98.95 |
| 1E1.016.025 | 0.64 | 0.8 | 96.95 | 98.21 |
| 1E1.016.026 | 0.48 | 7.2 | 86.29 | 98.66 |
| 1E1.016.027 | 0.41 | nd | nd | 97.59 |
| 1E1.016.028 | 0.32 | 0.7 | 97.8 | 98.56 |
| 1E1.016.029 | 0.31 | 7.4 | 85.66 | 98.85 |
| 1E1.016.030 | 0.28 | 1.1 | 96.91 | 98.28 |
| 1E1.016.031 | 0.31 | 7 | 85.33 | 99.03 |
| 1E1.016.032 | 0.25 | 7.9 | 84.47 | 98.88 |
| 1E1.016.033 | 3.06 | 0.7 | 97.7 | 99.59 |
| 1E1.016.034 | 1.20 | 7.1 | 86.53 | 98.68 |
| 1E1.016.035 | 0.48 | 0.8 | 98.77 | 99.56 |
| 1E1.016.036 | 0.44 | 0.7 | 97.91 | 99.66 |
| 1E1.016.037 | 0.34 | 7.2 | 86.33 | 98.95 |
| 1E1.016.038 | 0.33 | 0.9 | 97.67 | 99.70 |
| 1E1.016.039 | 0.52 | 7.8 | 85.42 | 99.08 |
| 1E1.016.040 | 0.27 | 7.9 | 85.02 | 99.01 |
| 1E1.016.041 | 2.11 | 0.6 | 98.98 | 99.65 |
| 1E1.016.042 | 1.23 | 6.1 | 89.2 | 99.21 |
| 1E1.016.043 | 0.41 | 0.6 | 99.42 | 98.65 |
| 1E1.016.044 | 0.40 | 0.7 | 98.01 | 99.74 |
| 1E1.016.045 | 0.33 | 6.3 | 88.43 | 96.14 |
| 1E1.016.046 | 0.32 | 0.7 | 98.01 | 99.96 |

FIGURE 18 (continued)

| | | | | |
|---|---|---|---|---|
| 1E1.016.047 | 0.46 | 6.5 | 88.63 | 99.37 |
| 1E1.016.048 | 0.27 | 7.1 | 87.21 | 99.19 |
| 1E1.016.049 | 0.53 | 0.6 | 97.79 | 99.80 |
| 1E1.016.050 | 0.46 | 6.2 | 88.71 | 99.16 |
| 1E1.016.051 | 0.31 | 0.6 | 98.96 | 99.74 |
| 1E1.016.052 | 0.32 | 0.6 | 98.11 | 99.77 |
| 1E1.016.053 | 0.29 | 6.4 | 87.86 | 99.27 |
| 1E1.016.054 | 0.27 | 0.9 | 97.79 | 99.69 |
| 1E1.016.055 | 0.36 | 6.7 | 87.77 | 99.15 |
| 1E1.016.056 | 0.27 | 6.7 | 87.39 | 99.15 |
| 1E1.016.057 | 0.42 | 0.7 | 98.78 | 85.31 |
| 1E1.016.058 | 0.39 | 7.8 | 86.44 | 96.08 |
| 1E1.016.059 | 0.31 | 0.7 | 99.32 | 99.60 |
| 1E1.016.060 | 0.29 | 0.6 | 98.05 | 99.43 |
| 1E1.016.061 | 0.29 | 7.8 | 85.78 | 99.06 |
| 1E1.016.062 | 0.29 | 0.8 | 97.82 | 99.49 |
| 1E1.016.063 | 0.31 | 8.1 | 85.72 | 99.25 |
| 1E1.016.064 | 0.29 | 8.4 | 85.04 | 99.14 |
| 1E1.016.065 | 2.77 | 0.6 | 98.97 | 99.91 |
| 1E1.016.066 | 1.42 | 6.7 | 87.83 | 98.97 |
| 1E1.016.067 | 0.53 | 0.6 | 98.87 | 99.53 |
| 1E1.016.068 | 0.50 | 0.6 | 98.12 | 99.81 |
| 1E1.016.069 | 0.38 | 7.1 | 86.83 | 99.14 |
| 1E1.016.070 | 0.35 | 0.6 | 97.92 | 99.69 |
| 1E1.016.071 | 0.50 | 6.4 | 87.57 | 99.30 |
| 1E1.016.072 | 0.34 | 7.3 | 86.42 | 99.17 |
| 1E1.016.073 | 0.61 | 0.6 | 98.14 | 99.61 |
| 1E1.016.074 | 0.55 | 5.5 | 90.13 | 99.40 |
| 1E1.016.075 | 0.37 | 0.6 | 99.02 | 99.55 |
| 1E1.016.076 | 0.37 | 0.6 | 98.27 | 99.80 |
| 1E1.016.077 | 0.32 | 6.3 | 88.69 | 99.25 |
| 1E1.016.078 | 0.33 | 0.7 | 98.1 | 99.83 |
| 1E1.016.079 | 0.38 | 5.7 | 90.09 | 99.95 |
| 1E1.016.080 | 0.32 | 6.7 | 88.13 | 99.87 |
| 1E1.016.081 | 0.00 | nd | nd | 99.45 |
| 1E1.016.082 | 3.95 | 7.4 | 85.73 | 98.87 |
| 1E1.016.083 | 0.00 | nd | nd | 0.00 |
| 1E1.016.084 | 0.96 | 0.9 | 98.38 | 99.10 |
| 1E1.016.085 | 0.47 | 7.4 | 85.89 | 99.09 |
| 1E1.016.086 | 0.00 | nd | nd | 0.00 |
| 1E1.016.087 | 0.81 | 7.5 | 84.5 | 99.07 |
| 1E1.016.088 | 0.35 | 7.8 | 84.81 | 98.98 |
| 1E1.016.089 | 0.44 | 0.6 | 98.03 | 99.72 |

FIGURE 18 (continued)

| | | | | |
|---|---|---|---|---|
| 1E1.016.090 | 0.44 | 5.3 | 90.88 | 99.59 |
| 1E1.016.091 | 0.34 | 0.6 | 98.07 | 99.63 |
| 1E1.016.092 | 0.32 | 0.7 | 98.11 | 99.94 |
| 1E1.016.093 | 0.35 | 6.2 | 89.2 | 99.46 |
| 1E1.016.094 | 0.32 | 0.9 | 97.83 | 99.92 |
| 1E1.016.095 | 0.35 | 5.7 | 90.64 | 99.77 |
| 1E1.016.096 | 0.25 | 6.7 | 88.92 | 94.95 |
| 1E1.016.097 | 2.28 | 0.8 | 97.95 | 98.76 |
| 1E1.016.098 | 1.41 | 5.3 | 91.17 | 95.57 |
| 1E1.016.099 | 0.55 | 0.9 | 97.47 | 98.59 |
| 1E1.016.100 | 0.40 | 0.6 | 98.07 | 98.62 |
| 1E1.016.101 | 0.31 | 5.6 | 90.33 | 94.75 |
| 1E1.016.102 | 0.31 | 0.8 | 98.02 | 98.87 |
| 1E1.016.103 | 0.45 | 5.7 | 90.85 | 95.00 |
| 1E1.016.104 | 0.30 | 7.1 | 88.61 | 94.19 |
| 1E1.016.105 | 2.64 | 0.6 | 98.06 | 98.74 |
| 1E1.016.106 | 1.61 | 6.2 | 88.28 | 93.22 |
| 1E1.016.107 | 0.50 | 1.2 | 96.7 | 98.23 |
| 1E1.016.108 | 0.48 | 0.8 | 97.78 | 98.28 |
| 1E1.016.109 | 0.32 | 6.6 | 87.82 | 93.49 |
| 1E1.016.110 | 0.33 | 0.7 | 98.01 | 98.69 |
| 1E1.016.111 | 0.51 | 6.8 | 87.42 | 92.87 |
| 1E1.016.112 | 0.32 | 7.5 | 86.68 | 93.20 |
| 1E1.016.113 | 2.13 | 0.7 | 97.95 | 98.56 |
| 1E1.016.114 | 1.05 | 6.7 | 87.79 | 92.85 |
| 1E1.016.115 | 0.54 | 1.1 | 97.07 | 98.56 |
| 1E1.016.116 | 0.56 | 0.9 | 97.61 | 98.58 |
| 1E1.016.117 | 0.33 | 6.6 | 88.1 | 92.78 |
| 1E1.016.118 | 0.40 | 0.7 | 97.95 | 96.12 |
| 1E1.016.119 | 0.66 | 7 | 87.13 | 92.18 |
| 1E1.016.120 | 0.27 | 7.8 | 86.25 | 91.34 |
| 1E1.016.121 | 2.32 | 0.8 | 97.99 | 98.85 |
| 1E1.016.122 | 1.16 | 5.5 | 91.24 | 93.12 |
| 1E1.016.123 | 0.43 | 0.9 | 97.62 | 99.25 |
| 1E1.016.124 | 0.42 | 0.9 | 97.69 | 98.83 |
| 1E1.016.125 | 0.29 | 5.5 | 90.86 | 87.51 |
| 1E1.016.126 | 0.28 | 0.9 | 97.94 | 99.42 |
| 1E1.016.127 | 0.44 | 5.4 | 91.5 | 97.14 |
| 1E1.016.128 | 0.31 | 1 | 97.13 | 99.02 |
| 1E1.016.129 | 0.30 | 1 | 97.75 | 97.35 |
| 1E1.016.130 | 0.34 | 0.8 | 97.51 | 98.85 |
| 1E1.016.131 | 0.34 | 0.5 | 97.05 | 98.02 |
| 1E1.016.132 | 0.29 | 6.9 | 88.32 | 94.44 |

FIGURE 18 (continued)

| | | | | |
|---|---|---|---|---|
| 1E1.016.139 | 0.47 | 0.8 | 97.54 | 95.45 |
| 1E1.016.140 | 0.96 | nd | nd | 97.38 |
| 1E1.016.141 | 0.47 | 1.5 | 96.92 | 99.23 |
| 1E1.016.142 | 1.78 | 0.7 | 97.83 | 99.03 |
| 1E1.016.148 | 0.84 | 0.7 | 97.4 | 98.78 |
| 1E1.016.149 | 0.39 | 0.7 | 98.08 | 98.85 |
| 1E1.016.150 | 0.31 | 0.7 | 97.92 | 98.84 |
| 1E1.016.151 | 0.32 | 1.1 | 97.78 | 98.50 |
| 1E1.016.152 | 0.70 | 0.8 | 97.98 | 98.87 |
| 1E1.016.153 | 0.98 | 0.6 | 97.98 | 98.62 |
| 1E1.016.154 | 0.46 | 0.6 | 98.09 | 98.82 |
| 1E1.016.155 | 0.41 | 0.7 | 97.64 | 98.50 |
| 1E1.016.156 | 0.28 | 1.3 | 97.52 | 98.76 |
| 1E1.016.157 | 0.50 | 0.7 | 97.96 | 98.83 |
| 1E1.016.158 | 0.94 | 1.3 | 97.5 | 98.75 |
| 1E1.016.159 | 0.42 | 11.1 | 80.86 | 91.35 |

* used as a control.

FIGURE 18 (continued)

Table 12: TIGIT Hotspot Engineering

| AB# | Recovery (mg/L) | SEC pp MP (%) | Tm (°C) | Ave Jurkat RGA Interpolated EC50 (ug/ml) (C2) |
|---|---|---|---|---|
| 4G10 | 348 | 4 | 65 | 0.39 |
| 11A3 | 223 | 1 | 70 | 0.14 |
| 28B8 | 140 | 9 | 76 | 0.38 |
| 39D2 | 224 | 12 | 64 | 0.19 |
| 43B7 | 173 | 10 | 67 | 0.17 |
| 55G7 | 17 | 25 | nd | 3.18 |
| 66H9 | 161 | 2 | 67 | 0.22 |
| 43B7.002 | 245 | 12 | 69 | 0.15 |
| 58A7.002 | 171 | 7 | 73 | 0.52 |
| 58A7.003 | 183 | 6 | 66 | 0.73 |
| 66H9.004 | 132 | 2 | 70 | 0.75 |
| 66H9.005 | 165 | 3 | 66 | 0.67 |
| 66H9.006 | 121 | 2 | 69 | 0.50 |
| 66H9.007 | 141 | 2 | 68 | 0.27 |
| 66H9.008 | 106 | 2 | 68 | 0.28 |
| 66H9.009 | 152 | 2 | 67 | 0.19 |
| 66H9.010 | 155 | 2 | 69 | 0.23 |
| 58A7.002.004 | 193 | 9 | 69 | 0.65 |
| 58A7.002.005 | 207 | 12 | 70 | 0.80 |
| 58A7.002.006 | 218 | 9 | 70 | 0.91 |
| 58A7.002.008 | 259 | 12 | 66 | 1.46 |
| 58A7.002.009 | 217 | 11 | 67 | 0.66 |
| 58A7.003.001 | 187 | 6 | 69 | 9.90 |
| 58A7.003.002 | 161 | 12 | 74 | 7.04 |
| 58A7.003.004 | 185 | 8 | 71 | 0.65 |
| 58A7.003.005 | 165 | 10 | 67 | 0.41 |
| 58A7.003.006 | 150 | 9 | 71 | 0.49 |
| 58A7.003.008 | 191 | 11 | 70 | 0.39 |
| 58A7.003.009 | 171 | 10 | 71 | 0.87 |
| 58A7.003.016 | 173 | 16 | 69 | 8.60 |
| 58A7.003.019 | 151 | 15 | 69 | 4.59 |
| 55G7.004 | 8 | 29 | nd | 2.48 |
| 55G7.005 | 18 | 28 | nd | 1.21 |
| 55G7.006 | 19 | 31 | nd | 2.59 |
| 55G7.037 | 9 | 49 | 69 | 1.44 |
| 55G7.038 | 12 | 30 | 69 | 2.82 |
| 55G7.041 | 27 | 31 | nd | 1.37 |

FIGURE 18 (continued)

| | | | | |
|---|---|---|---|---|
| 55G7.042 | 29 | 11 | nd | 2.87 |
| 55G7.043 | 23 | 19 | nd | 4.83 |
| 28B8.003 | 148 | 7 | 74 | 0.32 |
| 28B8.004 | 150 | 10 | 73 | 0.33 |
| 28B8.005 | 153 | 8 | 69 | 0.29 |
| 28B8.006 | 112 | 10 | 76 | 0.26 |
| 28B8.007 | 131 | 7 | 77 | 0.31 |
| 28B8.008 | 128 | 11 | 71 | 0.34 |
| 28B8.009 | 122 | 9 | 78 | 0.33 |
| 43B7.002.001 | 193 | 8 | 66 | 0.25 |
| 43B7.002.002 | 240 | 14 | 64 | 0.24 |
| 43B7.002.003 | 252 | 14 | 69 | 0.37 |
| 43B7.002.004 | 240 | 11 | 69 | 0.22 |
| 43B7.002.005 | 229 | 11 | 70 | 0.23 |
| 43B7.002.006 | 199 | 9 | 72 | 0.16 |
| 43B7.002.007 | 219 | 9 | 72 | 0.27 |
| 43B7.002.008 | 201 | 7 | 72 | 0.11 |
| 43B7.002.009 | 223 | 18 | 70 | 0.21 |
| 43B7.002.010 | 227 | 16 | 70 | 0.23 |
| 43B7.002.011 | 274 | 13 | 69 | 0.21 |
| 43B7.002.012 | 250 | 13 | 69 | 0.15 |
| 43B7.002.013 | 199 | 12 | 68 | 0.31 |
| 43B7.002.014 | 211 | 11 | 68 | 0.21 |
| 43B7.002.015 | 217 | 7 | 71 | 0.17 |
| 43B7.002.016 | 212 | 9 | 72 | 0.21 |
| 43B7.002.017 | 261 | 17 | 68 | 0.23 |
| 43B7.002.018 | 281 | 16 | 69 | 0.28 |
| 43B7.002.019 | 206 | 12 | 70 | 0.28 |
| 43B7.002.020 | 207 | 11 | 71 | 0.17 |
| 39D2.003 | 209 | 12 | 66 | 0.39 |
| 39D2.004 | 225 | 11 | 65 | 0.17 |
| 39D2.006 | 206 | 11 | 65 | 0.22 |
| 39D2.011 | 183 | 10 | 66 | 0.25 |
| 39D2.013 | 203 | 9 | 65 | 0.15 |
| 39D2.014 | 174 | 12 | 66 | 0.31 |
| 39D2.015 | 192 | 12 | 66 | 0.28 |
| 39D2.016 | 223 | 10 | 66 | 0.24 |
| 39D2.018 | 178 | 9 | 68 | 0.20 |
| 39D2.020 | 129 | 10 | 67 | 0.37 |
| 39D2.022 | 198 | 9 | 62 | 0.23 |
| 39D2.024 | 191 | 11 | 57 | 0.19 |
| 39D2.025 | 182 | 10 | 54 | 0.17 |
| 39D2.027 | 101 | 9 | 58 | 0.15 |

FIGURE 18 (continued)

| | | | | |
|---|---|---|---|---|
| 39D2.028 | 209 | 11 | 60 | 0.21 |
| 39D2.030 | 187 | 9 | 66 | 0.15 |
| 39D2.031 | 153 | 14 | 68 | 0.17 |
| 39D2.032 | 173 | 11 | 69 | 0.17 |
| 39D2.034 | 188 | 0 | 69 | 0.21 |
| 39D2.037 | 166 | 19 | 67 | 0.26 |
| 39D2.038 | 153 | 20 | 68 | 0.26 |
| 39D2.039 | 223 | 16 | 70 | 0.22 |
| 39D2.040 | 176 | 19 | 65 | 0.19 |
| 4G10.003 | 498 | 4 | 64 | 0.33 |
| 4G10.004 | 493 | 5 | 66 | 0.55 |
| 4G10.005 | 455 | 5 | 67 | 0.61 |
| 4G10.006 | 379 | 6 | 68 | 0.75 |
| 4G10.007 | 336 | 5 | 66 | 0.85 |
| 4G10.008 | 357 | 5 | 66 | 0.73 |
| 4G10.009 | 327 | 6 | 69 | 0.38 |
| 4G10.010 | 370 | 7 | 69 | 0.90 |
| 4G10.011 | 341 | 5 | 68 | 0.39 |
| 4G10.012 | 345 | 5 | 68 | 0.98 |
| 4G10.013 | 426 | 6 | 70 | 0.51 |
| 4G10.014 | 423 | 6 | 67 | 1.03 |
| 4G10.015 | 394 | 5 | 67 | 0.69 |
| 4G10.016 | 368 | 5 | 70 | 1.51 |
| 4G10.017 | 357 | 6 | 71 | 1.51 |
| 4G10.018 | 346 | 7 | 67 | 2.57 |
| 4G10.019 | 298 | 6 | 66 | 2.07 |
| 4G10.020 | 328 | 8 | 66 | 1.77 |
| 4G10.021 | 321 | 7 | 69 | 1.76 |
| 4G10.022 | 367 | 6 | 73 | 2.95 |
| 4G10.023 | 370 | 6 | 72 | 1.22 |
| 4G10.024 | 375 | 6 | 71 | 0.99 |
| 4G10.025 | 404 | 5 | 72 | 1.10 |
| 4G10.026 | 366 | 6 | 72 | 2.03 |
| 4G10.027 | 390 | 5 | 55 | 2.01 |
| 11A3.003 | 221 | 1 | 66 | 0.12 |
| 11A3.004 | 172 | 2 | 64 | 0.11 |
| 11A3.005 | 221 | 1 | 69 | 0.09 |
| 11A3.006 | 242 | 2 | 76 | 4.17 |
| 11A3.007 | 60 | 3 | 73 | 2.11 |
| 11A3.009 | 97 | 2 | 75 | 0.14 |
| 11A3.010 | 169 | 1 | 71 | 0.11 |
| 11A3.011 | 225 | 2 | 68 | 9.85 |
| 11A3.012 | 192 | 3 | 68 | 3.56 |

FIGURE 18 (continued)

| | | | | |
|---|---|---|---|---|
| 11A3.015 | 202 | 3 | 67 | 2.16 |
| 11A3.018 | 223 | 2 | 69 | 4.28 |
| 11A3.021 | 180 | 2 | 72 | 2.84 |
| 11A3.024 | 218 | 2 | 66 | 2.76 |

FIGURE 18 (continued)

Table 13 TIGIT Framework Engineering (Fv 1 Target = Human TIGIT)

| Ab ID | Initial RCA Averaged Conc µg/mL | Titer (mg/L) | Recovery (mg/L) | SEC pre MH (%) | MH (%) | SEC MH Average | SEC AMP Act-DC |
|---|---|---|---|---|---|---|---|
| 55G7.041* | 4.49 | 692 | 477 | 7.2 | 95.8 | 66.8 | 97.6 | 1.7 |
| 55G7.041.001 | 6.61 | 756 | 486 | 5.2 | 97.0 | 66.5 | 97.1 | -0.2 |
| 55G7.041.002 | 7.04 | 753 | 545 | 4.3 | 96.7 | 65.2 | 98.0 | 0.4 |
| 55G7.041.004 | 6.70 | 774 | 548 | 3.6 | 97.5 | 70.2 | 97.6 | -0.8 |
| 55G7.041.006 | 4.91 | 762 | 548 | 4.8 | 97.1 | 66.6 | 98.5 | 0.7 |
| 55G7.041.008 | 5.92 | 764 | 522 | 3.4 | 97.5 | 68.8 | 97.9 | -0.7 |
| 55G7.041.010 | 4.58 | 695 | 516 | 3.2 | 97.3 | 68.8 | 97.5 | -0.6 |
| 43B7.002* | 3.44 | 396 | 305 | 2.2 | 97.4 | 76.9 | 98.2 | -0.8 |
| 43B7.002.015.006 | 3.90 | 485 | 337 | 1.9 | 92.5 | 75.2 | 98.5 | -1.0 |
| 43B7.002.015.008 | 6.59 | 644 | 373 | 6.2 | 94.2 | 71.6 | 98.8 | 0.6 |
| 43B7.002.015.009 | 3.30 | 483 | 341 | 0.7 | 97.0 | 72.0 | 98.8 | -0.8 |
| 43B7.002.015.010 | 3.02 | 511 | 392 | 2.1 | 96.3 | 72.5 | 96.7 | -2.1 |
| 43B7.002.015.012 | 3.30 | 519 | 289 | 1.9 | 98.5 | 70.9 | 98.7 | -0.5 |
| 43B7.002.015.014 | 4.72 | 574 | 350 | 2.5 | 97.2 | 70.7 | 98.0 | -0.8 |
| 43B7.002.015.017 | 7.46 | 439 | 256 | 8.3 | 98.1 | 70.2 | 98.8 | 2.2 |
| 66H9* | 6.38 | 511 | 363 | 4.6 | 96.0 | 80.5 | 98.8 | 0.1 |
| 66H9.009* | 6.00 | 509 | 341 | 4.7 | 95.7 | 71.9 | 98.0 | -0.5 |
| 66H9.011 | 5.62 | 468 | 311 | 0.6 | 99.1 | 72.8 | 99.4 | -0.5 |
| 66H9.012 | 4.88 | 595 | 405 | 3.2 | 97.9 | 73.4 | 96.3 | -2.6 |
| 66H9.017 | 9.22 | 463 | 331 | 0.8 | 98.3 | 73.7 | 99.3 | -0.5 |

* used as a control

FIGURE 18 (continued)

Table 14 TIGIT Yeast Display Engineering 1

| Ab | Input RGA Antibody (ng/ml) | Input RGA Antibody Activity | Recovery (g/L) | %HMW (AS SEC) | Mol Wt Match |
|---|---|---|---|---|---|
| 4387.002.015* | 1.28 | 5.39 | 176 | 2.1 | 99.1 |
| 4387.002.015.006 | 1.60 | 4.62 | 234 | 5.3 | 98.4 |
| 4387.002.015.008 | 1.24 | 5.16 | 242 | 0.8 | 99.5 |
| 4387.002.015.002 | 2.21 | 5.39 | 267 | 4.5 | 98.3 |
| 4387.002.015.014 | 0.91 | 4.62 | 274 | 0.9 | 96.9 |
| 4387.002.015.AM001 | 0.60 | 4.61 | 197 | 6.4 | 99.2 |
| 4387.002.015.AM002 | 0.70 | 5.26 | 200 | 4.2 | 99.2 |
| 4387.002.015.AM003 | 0.79 | 6.12 | 200 | 2.7 | 99.0 |
| 4387.002.015.AM022 | 0.64 | 4.70 | 218 | 9.2 | 98.7 |
| 4387.002.015.AM005 | 1.11 | 6.40 | 224 | 4.8 | 98.8 |
| 4387.002.015.AM006 | 1.29 | 4.94 | 175 | 6.8 | 98.8 |
| 4387.002.015.AM007 | 1.04 | 5.18 | 204 | 5.8 | 99.0 |
| 4387.002.015.AM008 | 1.05 | 4.94 | 140 | 4.9 | 98.9 |
| 4387.002.015.AM009 | 1.04 | 5.81 | 226 | 4.4 | 99.0 |
| 4387.002.015.AM010 | 0.66 | 5.48 | 215 | 7.3 | 98.7 |
| 4387.002.015.AM011 | 0.82 | 6.19 | 226 | 4.1 | 99.0 |
| 4387.002.015.AM012 | 1.45 | 6.51 | 205 | 4.4 | 98.8 |
| 4387.002.015.AM013 | 1.22 | 6.68 | 182 | 5.5 | 98.9 |
| 4387.002.015.AM108 | 0.67 | 4.81 | 215 | 11.6 | 99.0 |
| 4387.002.015.AM015 | 0.74 | 5.61 | 217 | 7.6 | 98.9 |
| 4387.002.015.AM104 | 0.68 | 5.61 | 243 | 21.1 | 99.1 |
| 4387.002.015.AM017 | 0.70 | 5.23 | 221 | 5.4 | 99.0 |
| 4387.002.015.AM018 | 0.62 | 5.61 | 200 | 3.0 | 99.0 |
| 4387.002.015.AM019 | 0.84 | 5.73 | 205 | 8.2 | 98.7 |
| 4387.002.015.AM016 | 0.74 | 4.66 | 200 | 6.3 | 98.9 |
| 4387.002.015.AM021 | 1.43 | 6.35 | 187 | 11.0 | 98.1 |
| 4387.002.015.AM092 | 0.75 | 4.79 | 159 | 14.3 | 99.0 |
| 4387.002.015.AM023 | 1.34 | 4.95 | 188 | 6.7 | 98.8 |
| 4387.002.015.AM024 | 0.85 | 4.84 | 184 | 5.3 | 98.8 |
| 4387.002.015.AM025 | 1.01 | 5.17 | 204 | 10.9 | 98.7 |
| 4387.002.015.AM026 | 0.92 | 6.10 | 192 | 7.0 | 99.3 |
| 4387.002.015.AM027 | 1.28 | 5.63 | 190 | 3.9 | 95.9 |
| 4387.002.015.AM096 | 0.78 | 6.27 | 209 | 15.3 | 98.6 |
| 4387.002.015.AM029 | 1.07 | 6.18 | 206 | 9.8 | 99.0 |
| 4387.002.015.AM030 | 1.18 | 5.34 | 182 | 11.1 | 99.0 |
| 4387.002.015.014.AM008 | 0.78 | 5.92 | 178 | 0.7 | 99.4 |
| 4387.002.015.AM032 | 0.66 | 4.95 | 153 | 7.7 | 98.9 |
| 4387.002.015.AM033 | 0.68 | 4.87 | 199 | 7.3 | 99.3 |
| 4387.002.015.AM034 | 1.40 | 6.78 | 231 | 11.4 | 98.6 |

FIGURE 18 (continued)

| | | | | | |
|---|---|---|---|---|---|
| 43B7.002.015.AM035 | 0.82 | 5.73 | 203 | 5.3 | 98.8 |
| 43B7.002.015.AM091 | 0.84 | 5.10 | 225 | 18.7 | 99.4 |
| 43B7.002.015.AM037 | 1.22 | 5.97 | 100 | 2.2 | 99.4 |
| 43B7.002.015.AM038 | 1.26 | 5.36 | 206 | 6.8 | 98.9 |
| 43B7.002.015.AM039 | 1.07 | 4.93 | 205 | 4.8 | 98.8 |
| 43B7.002.015.AM040 | 1.80 | 5.20 | 192 | 7.9 | 98.8 |
| 43B7.002.015.AM041 | 1.23 | 4.98 | 176 | 4.6 | 98.9 |
| 43B7.002.015.AM042 | 0.69 | 5.37 | 161 | 5.0 | 98.8 |
| 43B7.002.015.AM043 | 0.96 | 5.63 | 201 | 4.3 | 99.0 |
| 43B7.002.015.AM044 | 1.59 | 6.32 | 212 | 5.8 | 98.8 |
| 43B7.002.015.AM045 | 1.07 | 6.03 | 181 | 12.8 | 98.9 |
| 43B7.002.015.AM046 | 1.19 | 5.62 | 198 | 13.1 | 98.8 |
| 43B7.002.015.AM047 | 1.81 | 5.06 | 192 | 12.8 | 99.1 |
| 43B7.002.015.AM048 | 1.25 | 5.56 | 169 | 11.6 | 99.2 |
| 43B7.002.015.AM049 | 0.62 | 4.84 | 200 | 11.2 | 99.0 |
| 43B7.002.015.AM050 | 0.78 | 5.70 | 162 | 12.9 | 99.5 |
| 43B7.002.015.AM051 | 1.18 | 5.98 | 203 | 14.6 | 99.5 |
| 43B7.002.015.AM052 | 0.83 | 6.29 | 123 | 6.3 | 99.0 |
| 43B7.002.015.AM053 | 0.87 | 5.76 | 188 | 12.2 | 98.2 |
| 43B7.002.015.AM054 | 1.31 | 5.35 | 221 | 14.7 | 98.8 |
| 43B7.002.015.AM055 | 0.75 | 4.63 | 186 | 16.3 | 98.5 |
| 43B7.002.015.AM056 | 1.55 | 6.27 | 198 | 11.8 | 98.2 |
| 43B7.002.015.AM057 | 1.06 | 5.30 | 206 | 12.8 | 98.7 |
| 43B7.002.015.AM058 | 1.05 | 6.53 | 203 | 12.8 | 98.8 |
| 43B7.002.015.AM059 | 1.09 | 6.31 | 219 | 13.3 | 98.7 |
| 43B7.002.015.AM060 | 1.05 | 5.69 | 187 | 13.3 | 98.2 |
| 43B7.002.015.AM061 | 1.59 | 7.42 | 224 | 15.1 | 98.8 |
| 43B7.002.015.AM062 | 0.94 | 6.05 | 146 | 9.9 | 98.7 |
| 43B7.002.015.AM063 | 1.49 | 5.86 | 215 | 12.5 | 98.9 |
| 43B7.002.015.AM064 | 1.22 | 5.78 | 240 | 16.6 | 97.4 |
| 43B7.002.015.AM065 | 0.97 | 5.52 | 199 | 18.5 | 98.9 |
| 43B7.002.015.AM066 | 1.36 | 6.80 | 213 | 11.8 | 99.2 |
| 43B7.002.015.AM067 | 1.04 | 6.11 | 198 | 12.3 | 99.4 |
| 43B7.002.015.AM068 | 1.14 | 6.27 | 196 | 11.5 | 99.6 |
| 43B7.002.015.AM069 | 1.05 | 6.13 | 212 | 14.3 | 98.9 |
| 43B7.002.015.AM070 | 0.84 | 5.24 | 175 | 16.7 | 99.6 |
| 43B7.002.015.AM071 | 1.24 | 5.24 | 209 | 16.0 | 99.6 |
| 43B7.002.015.AM072 | 0.51 | 5.01 | 155 | 8.5 | 98.8 |
| 43B7.002.015.AM073 | 1.45 | 7.02 | 217 | 11.0 | 99.2 |
| 43B7.002.015.AM074 | 1.15 | 6.11 | 241 | 18.6 | 98.9 |
| 43B7.002.015.AM075 | 1.26 | 5.51 | 219 | 15.1 | 99.1 |
| 43B7.002.015.014.AM002 | 0.86 | 6.73 | 299 | 1.9 | 98.5 |
| 43B7.002.015.AM077 | 1.37 | 5.51 | 176 | 14.2 | 98.2 |

FIGURE 18 (continued)

| | | | | | |
|---|---|---|---|---|---|
| 4387.002.015.AM078 | 0.57 | 4.74 | 179 | 13.0 | 98.9 |
| 4387.002.015.AM079 | 0.86 | 5.07 | 197 | 15.2 | 99.4 |
| 4387.002.015.AM080 | 1.17 | 5.32 | 168 | 13.8 | 98.8 |
| 4387.002.015.AM081 | 1.19 | 5.74 | 194 | 15.9 | 99.6 |
| 4387.002.015.AM082 | 0.89 | 6.67 | 135 | 11.2 | 99.7 |
| 4387.002.015.AM102 | 0.87 | 5.82 | 148 | 13.8 | 99.1 |
| 4387.002.015.AM084 | 1.76 | 6.34 | 223 | 14.1 | 99.6 |
| 4387.002.015.AM083 | 0.88 | 7.82 | 193 | 15.0 | 99.4 |
| 4387.002.015.014.AM010 | 0.88 | 5.03 | 296 | 1.2 | 88.8 |
| 4387.002.015.AM087 | 1.45 | 5.02 | 190 | 15.5 | 99.0 |
| 4387.002.015.AM014 | 0.90 | 5.05 | 199 | 4.7 | 99.3 |
| 4387.002.015.AM089 | 1.29 | 4.96 | 229 | 19.5 | 98.6 |
| 4387.002.015.AM090 | 1.35 | 5.60 | 203 | 18.2 | 99.1 |
| 4387.002.015.AM036 | 0.91 | 5.72 | 185 | 4.2 | 98.9 |
| 4387.002.015.AM020 | 0.92 | 6.23 | 191 | 4.9 | 98.7 |
| 4387.002.015.AM098 | 0.92 | 4.79 | 222 | 18.6 | 98.5 |
| 4387.002.015.AM094 | 1.61 | 6.16 | 252 | 18.9 | 98.1 |
| 4387.002.015.AM095 | 1.30 | 4.59 | 229 | 18.8 | 98.3 |
| 4387.002.015.AM086 | 0.93 | 5.80 | 202 | 15.6 | 99.3 |
| 4387.002.015.AM076 | 0.93 | 5.96 | 196 | 14.1 | 98.8 |
| 4387.002.015.AM093 | 0.94 | 6.08 | 222 | 16.5 | 98.5 |
| 4387.002.015.AM099 | 1.11 | 5.39 | 229 | 19.5 | 99.0 |
| 4387.002.015.AM100 | 1.78 | 5.87 | 223 | 20.3 | 98.5 |
| 4387.002.015.AM101 | 1.13 | 6.63 | 224 | 20.0 | 98.1 |
| 4387.002.015.AM004 | 0.95 | 5.55 | 219 | 5.8 | 98.8 |
| 4387.002.015.AM103 | 1.32 | 5.17 | 227 | 14.3 | 99.1 |
| 4387.002.015.AM118 | 0.96 | 5.16 | 239 | 13.3 | 99.2 |
| 4387.002.015.AM105 | 1.67 | 5.17 | 201 | 12.9 | 99.4 |
| 4387.002.015.AM028 | 0.97 | 5.83 | 185 | 8.1 | 98.7 |
| 4387.002.015.AM107 | 1.47 | 5.30 | 176 | 10.8 | 98.7 |
| 4387.002.015.AM031 | 0.98 | 5.11 | 226 | 10.1 | 98.7 |
| 4387.002.015.AM109 | 0.98 | 6.08 | 205 | 13.1 | 99.0 |
| 4387.002.015.AM110 | 1.51 | 5.44 | 171 | 11.2 | 98.5 |
| 4387.002.015.AM111 | 1.41 | 6.31 | 197 | 12.9 | 98.7 |
| 4387.002.015.AM112 | 1.22 | 7.32 | 129 | 10.5 | 98.2 |
| 4387.002.015.AM113 | 1.19 | 4.93 | 197 | 18.0 | 98.7 |
| 4387.002.015.AM114 | 1.30 | 4.60 | 219 | 13.0 | 98.9 |
| 4387.002.015.AM115 | 1.21 | 4.93 | 227 | 17.2 | 99.4 |
| 4387.002.015.AM116 | 1.16 | 5.12 | 214 | 12.1 | 98.9 |
| 4387.002.015.AM117 | 1.38 | 5.69 | 193 | 8.8 | 98.8 |
| 4387.002.015.AM085 | 0.98 | 5.25 | 207 | 18.2 | 98.8 |
| 4387.002.015.AM119 | 1.24 | 5.56 | 222 | 15.4 | 98.5 |
| 4387.002.015.AM120 | 0.96 | 6.95 | 208 | 17.9 | 94.8 |

FIGURE 18 (continued)

| | | | | | |
|---|---|---|---|---|---|
| 43B7.002.015.AM121 | 3.43 | 3.63 | 218 | 14.0 | 96.2 |
| 43B7.002.015.AM122 | 0.66 | 5.01 | 175 | 11.0 | 97.1 |
| 43B7.002.015.AM123 | 1.13 | 5.19 | 198 | 10.4 | 91.9 |
| 43B7.002.015.AM124 | 1.25 | 5.37 | 251 | 18.3 | 97.4 |
| 43B7.002.015.AM125 | 1.47 | 5.99 | 222 | 17.9 | 96.3 |
| 43B7.002.015.AM126 | 1.39 | 5.55 | 212 | 9.7 | 93.9 |
| 43B7.002.015.AM127 | 1.79 | 4.71 | 179 | 7.6 | 96.5 |
| 43B7.002.015.AM128 | 1.46 | 6.75 | 233 | 13.8 | 95.5 |
| 43B7.002.015.AM129 | 1.37 | 5.50 | 243 | 16.1 | 96.4 |
| 43B7.002.015.AM130 | 1.07 | 4.98 | 198 | 18.6 | 96.4 |
| 43B7.002.015.AM131 | 1.37 | 5.56 | 208 | 14.4 | 96.5 |
| 43B7.002.015.AM132 | 1.17 | 5.31 | 175 | 11.6 | 99.4 |
| 43B7.002.015.AM133 | 1.23 | 6.12 | 222 | 11.7 | 98.9 |
| 43B7.002.015.AM134 | 1.45 | 4.91 | 243 | 17.6 | 99.1 |
| 43B7.002.015.AM135 | 1.26 | 5.07 | 200 | 18.4 | 99.5 |
| 43B7.002.015.AM136 | 1.18 | 6.18 | 218 | 20.0 | 99.2 |
| 43B7.002.015.AM137 | 1.46 | 4.62 | 210 | 28.5 | 99.4 |
| 43B7.002.015.AM138 | 1.22 | 6.07 | 203 | 16.0 | 96.1 |
| 43B7.002.015.AM139 | 1.81 | 5.33 | 208 | 18.3 | 96.8 |
| 43B7.002.015.AM140 | 1.84 | 5.39 | 202 | 16.6 | 96.8 |
| 43B7.002.015.AM141 | 1.38 | 6.36 | 224 | 18.0 | 95.9 |
| 43B7.002.015.AM142 | 0.76 | 5.07 | 143 | 16.5 | 96.1 |
| 43B7.002.015.AM143 | 1.31 | 5.89 | 208 | 19.8 | 96.7 |
| 43B7.002.015.AM144 | 1.36 | 6.79 | 216 | 19.8 | 95.8 |
| 43B7.002.015.002.AM001 | 2.77 | 5.16 | 243 | 10.5 | 89.9 |
| 43B7.002.015.002.AM002 | 1.71 | 4.89 | 258 | 9.3 | 99.0 |
| 43B7.002.015.002.AM003 | 1.95 | 4.86 | 256 | 9.3 | 87.8 |
| 43B7.002.015.002.AM004 | 2.06 | 5.09 | 254 | 8.4 | 92.6 |
| 43B7.002.015.002.AM005 | 1.83 | 5.48 | 250 | 11.2 | 99.0 |
| 43B7.002.015.002.AM006 | 2.43 | 5.50 | 231 | 8.9 | 99.0 |
| 43B7.002.015.002.AM007 | 4.12 | 5.46 | 221 | 9.2 | 89.1 |
| 43B7.002.015.002.AM008 | 1.49 | 6.59 | 192 | 7.9 | 98.7 |
| 43B7.002.015.002.AM009 | 2.67 | 5.42 | 221 | 10.9 | 98.8 |
| 43B7.002.015.002.AM010 | 2.57 | 4.61 | 255 | 10.5 | 99.2 |
| 43B7.002.015.006.AM001 | 1.26 | 5.17 | 307 | 2.1 | 98.9 |
| 43B7.002.015.006.AM002 | 1.78 | 6.66 | 272 | 0.9 | 98.5 |
| 43B7.002.015.006.AM003 | 1.08 | 6.27 | 290 | 1.9 | 96.1 |
| 43B7.002.015.006.AM004 | 1.40 | 5.89 | 292 | 1.4 | 95.8 |
| 43B7.002.015.006.AM005 | 1.39 | 5.39 | 307 | 2.4 | 97.1 |
| 43B7.002.015.006.AM006 | 1.29 | 7.03 | 274 | 2.6 | 99.6 |
| 43B7.002.015.006.AM007 | 1.53 | 4.97 | 259 | 2.3 | 95.8 |
| 43B7.002.015.006.AM008 | 0.60 | 5.32 | 201 | 0.6 | 89.5 |
| 43B7.002.015.006.AM009 | 0.92 | 5.05 | 266 | 0.8 | 98.8 |

FIGURE 18 (continued)

| | | | | | |
|---|---|---|---|---|---|
| 4387.002.015.006.AM010 | 1.03 | 5.11 | 315 | 2.3 | 99.3 |
| 4387.002.015.008.AM001 | 2.38 | 6.45 | 258 | 10.0 | 99.1 |
| 4387.002.015.008.AM002 | 1.08 | 5.07 | 264 | 8.4 | 99.2 |
| 4387.002.015.008.AM003 | 2.03 | 4.83 | 276 | 8.6 | 98.2 |
| 4387.002.015.008.AM004 | 2.26 | 6.63 | 265 | 8.8 | 98.0 |
| 4387.002.015.008.AM005 | 1.73 | 5.60 | 277 | 11.4 | 97.2 |
| 4387.002.015.008.AM006 | 1.96 | 5.62 | 254 | 7.6 | 96.1 |
| 4387.002.015.008.AM007 | 2.46 | 6.10 | 229 | 8.2 | 99.7 |
| 4387.002.015.008.AM008 | 1.29 | 5.41 | 196 | 9.0 | 97.1 |
| 4387.002.015.008.AM009 | 4.46 | 5.14 | 248 | 9.9 | 90.9 |
| 4387.002.015.008.AM010 | 2.22 | 5.73 | 256 | 11.0 | 98.2 |
| 4387.002.015.014.AM001 | 1.30 | 5.05 | 291 | 1.9 | 99.6 |
| 4387.002.015.AM088 | 1.01 | 5.50 | 192 | 13.9 | 99.6 |
| 4387.002.015.014.AM003 | 1.36 | 5.30 | 294 | 1.9 | 98.7 |
| 4387.002.015.014.AM004 | 1.04 | 5.85 | 289 | 1.5 | 98.8 |
| 4387.002.015.014.AM005 | 0.90 | 4.65 | 276 | 1.7 | 94.9 |
| 4387.002.015.014.AM006 | 1.65 | 5.75 | 291 | 1.4 | 96.5 |
| 4387.002.015.014.AM007 | 1.42 | 5.52 | 150 | 0.8 | 99.4 |
| 4387.002.015.AM106 | 1.01 | 5.33 | 201 | 16.3 | 99.2 |
| 4387.002.015.014.AM009 | 1.34 | 6.66 | 284 | 1.3 | 96.8 |
| 4387.002.015.AM097 | 1.02 | 4.98 | 215 | 14.8 | 98.0 |

* used as a control.

FIGURE 18 (continued)

Table 15 TIGIT Yeast Display Engineering 2

| AIIDs | TIGIT Ankat RGA EC50 (nM) | SEC prep MP (%) | SEC MP (%) | MCE NR MP (%) |
|---|---|---|---|---|
| 58A7.003.008* | 3.53 | 6.14 | 93.86 | 97.71 |
| 58A7.003.008.001 | 1.86 | 3.68 | 96.32 | 97.55 |
| 58A7.003.008.002 | 3.07 | 7.55 | 92.45 | 91.05 |
| 58A7.003.008.003 | 2.17 | 3.39 | 96.61 | 97.83 |
| 58A7.003.008.005 | 1.99 | 16.07 | 79.1 | 97.72 |
| 58A7.003.008.007 | 1.60 | 10.44 | 89.56 | 97.76 |
| 58A7.003.008.008 | 1.55 | 12.22 | 87.56 | 97.06 |
| 58A7.003.008.009 | 3.18 | 3.4 | 96.6 | 97.69 |
| 58A7.003.008.010 | 2.71 | 3.85 | 96.15 | 96.94 |
| 58A7.003.008.011 | 2.17 | 2.81 | 97.19 | 95.49 |
| 58A7.003.008.012 | 3.97 | 5.55 | 94.45 | 97.41 |
| 58A7.003.008.013 | 4.41 | 5.79 | 94.21 | 97.85 |
| 58A7.003.008.014 | 2.80 | 3.48 | 96.52 | 97.90 |
| 58A7.003.008.015 | 2.04 | 3.92 | 96.08 | 97.81 |
| 58A7.003.008.016 | 3.98 | 0.38 | 99.62 | 97.93 |
| 58A7.003.008.017 | 4.16 | 0.36 | 99.64 | 97.04 |
| 58A7.003.008.018 | 1.67 | 4.04 | 95.45 | 95.77 |
| 58A7.003.008.019 | 2.02 | 5.12 | 94.88 | 96.72 |
| 58A7.003.008.020 | 3.23 | 4.97 | 95.03 | 96.34 |
| 58A7.003.008.021 | 5.57 | 6.95 | 93.05 | 97.50 |
| 58A7.003.008.022 | 3.29 | 3.51 | 95.93 | 98.28 |
| 58A7.003.008.023 | 2.14 | 3.56 | 96.12 | 97.91 |
| 58A7.003.008.024 | 2.31 | 4.24 | 95.43 | 97.58 |
| 58A7.003.008.027 | 4.25 | 2.66 | 97.34 | 97.64 |
| 58A7.003.008.034 | 2.34 | 1.13 | 98.87 | 97.33 |
| 58A7.003.008.035 | 4.48 | 7.26 | 92.74 | 98.07 |
| 58A7.003.008.036 | 7.42 | 1.88 | 98.12 | 98.17 |
| 58A7.003.008.037 | 6.71 | 11.13 | 88.87 | 97.81 |
| 58A7.003.008.038 | 7.77 | 7.32 | 92.68 | 97.73 |
| 58A7.003.008.039 | 4.28 | 6.5 | 93.5 | 97.08 |
| 58A7.003.008.040 | 8.23 | 6.2 | 93.8 | 97.62 |
| 58A7.003.008.041 | 6.37 | 6.42 | 93.58 | 97.70 |
| 58A7.003.008.042 | 3.83 | 6.98 | 93.02 | 98.25 |
| 58A7.003.008.043 | 2.29 | 8.42 | 91.58 | 97.88 |
| 58A7.003.008.044 | 3.44 | 7.71 | 92.29 | 98.18 |
| 58A7.003.008.045 | 4.09 | 7.52 | 92.48 | 98.48 |
| 58A7.003.008.046 | 1.64 | 0.6 | 99.4 | 98.20 |
| 58A7.003.008.047 | 1.80 | 4.57 | 95 | 98.55 |
| 58A7.003.008.048 | 7.11 | 8.57 | 90.96 | 97.81 |
| 58A7.003.008.049 | 3.60 | 8.25 | 91.75 | 97.62 |

FIGURE 18 (continued)

| | | | | |
|---|---|---|---|---|
| 58A7.003.008.050 | 2.05 | 7.28 | 92.72 | 98.28 |
| 58A7.003.008.051 | 2.54 | 7.23 | 92.37 | 98.15 |
| 58A7.003.008.052 | 4.02 | 8.45 | 91.55 | 98.19 |
| 58A7.003.008.053 | 3.54 | 3.71 | 96.29 | 98.31 |
| 58A7.003.008.054 | 3.98 | 7.69 | 92.31 | 98.27 |
| 58A7.003.008.055 | 2.86 | 7.13 | 92.87 | 98.01 |
| 58A7.003.008.056 | 3.09 | 1.43 | 98.57 | 98.10 |
| 58A7.003.008.057 | 4.50 | 9.45 | 90.07 | 97.75 |
| 58A7.003.008.058 | 1.66 | 0.5 | 99.5 | 98.47 |
| 58A7.003.008.059 | 1.59 | 4.86 | 95.14 | 98.06 |
| 58A7.003.008.060 | 4.95 | 9.8 | 87.4 | 94.00 |
| 58A7.003.008.061 | 2.47 | 5.04 | 94.96 | 97.85 |
| 58A7.003.008.062 | 3.20 | 6.69 | 93.31 | 97.89 |
| 58A7.003.008.063 | 1.71 | 0.39 | 99.61 | 97.85 |
| 58A7.003.008.064 | 2.05 | 6.01 | 93.99 | 97.74 |
| 58A7.003.008.065 | 2.70 | 6.07 | 93.93 | 97.75 |
| 58A7.003.008.066 | 1.88 | 7.43 | 92.57 | 98.38 |
| 58A7.003.008.067 | 2.53 | 6.89 | 93.11 | 98.04 |
| 58A7.003.008.068 | 2.96 | 2.72 | 97.28 | 98.52 |
| 58A7.003.008.069 | 3.49 | 8.09 | 91.41 | 97.99 |
| 58A7.003.008.071 | 3.14 | 6.91 | 92.71 | 97.45 |
| 58A7.003.008.072 | 3.56 | 2.58 | 97.42 | 98.38 |
| 58A7.003.008.073 | 2.41 | 0.68 | 99.32 | 97.87 |
| 58A7.003.008.074 | 2.08 | 2.36 | 97.64 | 98.03 |
| 58A7.003.008.075 | 0.95 | 5.88 | 93.45 | 97.53 |
| 58A7.003.008.076 | 3.02 | 8.57 | 91.43 | 97.91 |
| 58A7.003.008.077 | 3.66 | 8.8 | 91.2 | 97.61 |
| 58A7.003.008.078 | 2.99 | 7.68 | 92.32 | 97.97 |
| 58A7.003.008.079 | 1.98 | 9.25 | 90.75 | 97.72 |
| 58A7.003.008.080 | 3.55 | 7.57 | 88.21 | 94.28 |
| 58A7.003.008.081 | 3.44 | 7.85 | 92.15 | 97.65 |
| 58A7.003.008.082 | 1.52 | 2.31 | 97.69 | 98.24 |
| 58A7.003.008.083 | 1.23 | 7.02 | 92.98 | 97.48 |
| 58A7.003.008.084 | 3.88 | 2.51 | 97.49 | 98.46 |
| 58A7.003.008.085 | 5.95 | 8.44 | 88.73 | 94.45 |
| 58A7.003.008.086 | 3.08 | 5.36 | 94.64 | 97.65 |
| 58A7.003.008.087 | 2.06 | 7.35 | 92.65 | 97.85 |
| 58A7.003.008.088 | 3.42 | 4.3 | 95.7 | 97.16 |
| 58A7.003.008.089 | 6.99 | 2.68 | 97.32 | 97.72 |
| 58A7.003.008.090 | 3.09 | 2.89 | 84.55 | 88.18 |
| 58A7.003.008.091 | 4.73 | 6.09 | 93.54 | 97.73 |
| 58A7.003.008.092 | 1.68 | 8.67 | 91.33 | 97.66 |
| 58A7.003.008.094 | 4.85 | 3.84 | 96.16 | 97.32 |

FIGURE 18 (continued)

| | | | | |
|---|---|---|---|---|
| 58A7.003.008.096 | 8.51 | 14.92 | 85.08 | 98.80 |
| 58A7.003.008.098 | 7.08 | 11.49 | 88.01 | 97.44 |
| 58A7.003.008.099 | 7.97 | 13.24 | 83.35 | 93.84 |
| 58A7.003.008.100 | 9.92 | 13.83 | 85.86 | 93.90 |
| 58A7.003.008.103 | 6.96 | 7.66 | 91.81 | 97.17 |
| 58A7.003.008.104 | 6.97 | 7.07 | 92.41 | 96.82 |
| 58A7.003.008.106 | 9.07 | 14.18 | 85.82 | 96.15 |
| 58A7.003.008.110 | 5.59 | 7.6 | 92.4 | 97.45 |
| 58A7.003.008.111 | 2.56 | 7.31 | 92.11 | 97.29 |
| 58A7.003.008.113 | 3.37 | 5.1 | 94.9 | 97.71 |
| 58A7.003.008.134 | 5.86 | 1.59 | 98.41 | 97.56 |
| 58A7.003.008.136 | 4.73 | 9.78 | 90.22 | 94.33 |
| 58A7.003.008.138 | 4.94 | 8.34 | 91.66 | 97.51 |
| 58A7.003.008.139 | 5.14 | 9.34 | 88.38 | 93.66 |
| 58A7.003.008.140 | 4.71 | 8.75 | 91.25 | 97.49 |
| 58A7.003.008.141 | 5.47 | 8.24 | 91.76 | 97.38 |
| 58A7.003.008.142 | 9.81 | 13.67 | 86.33 | 97.21 |
| 58A7.003.008.143 | 3.42 | 5.23 | 94.77 | 97.05 |
| 58A7.003.008.144 | 3.79 | 5.56 | 94.44 | 96.85 |
| 58A7.003.008.145 | 2.15 | 6.12 | 93.88 | 96.24 |
| 58A7.003.008.146 | 5.80 | 24.1 | 75.9 | 97.15 |
| 58A7.003.008.147 | 6.00 | 7.32 | 92.68 | 96.50 |
| 58A7.003.008.148 | 4.55 | 22.44 | 77.56 | 97.07 |
| 58A7.003.008.150 | 6.20 | 4.27 | 95.73 | 97.24 |

* used as a control.

FIGURE 18 (continued)

Table 16 human TIGIT Binding Characterization

| Alias | Bionet # | $k_a$ (1/Ms) | $k_d$ (1/s) | $K_D$ (M) | R_max (RU) |
|---|---|---|---|---|---|
| 43B7.002.015 | 5310-3 | 3.81E+06 | 1.98E-04 | 5.19E-11 | 20.7 |
| 55G7.041 | 1325-4 | 1.82E+06 | 4.16E-04 | 2.28E-10 | 68.9 |
| 58A7.003.008 | 5311-4 | 1.94E+06 | 5.49E-04 | 2.83E-10 | 24.8 |
| 66H9.009 | 5312-3 | 2.07E+06 | 1.08E-04 | 5.23E-11 | 22.8 |

Table 17 cynomolgus TIGIT Binding Characterization

| Alias | Bionet # | $K_D$ (M) | R_max (RU) |
|---|---|---|---|
| 43B7.002.015 | 5310-3 | 1.30E-08 | 25.1 |
| 55G7.041 | 1325-4 | 2.50E-08 | 80.8 |
| 58A7.003.008 | 5311-4 | 9.39E-09 | 25.3 |
| 66H9.009 | 5312-3 | 3.47E-08 | 21.4 |

Table 18 human CD112R Binding Characterization

| Alias | Bionet # | $k_a$ (1/Ms) | $k_d$ (1/s) | $K_D$ (M) | R_max (RU) |
|---|---|---|---|---|---|
| 1E1.016 | 8429-3 | 6.00E+06 | 1.17E-03 | 1.95E-10 | 23.3 |
| 11F4 | 8473-4 | 2.46E+06 | 1.34E-03 | 5.43E-10 | 35.4 |
| 24F1 | 12483-1 | 5.33E+06 | 1.69E-04 | 3.17E-11 | 29.8 |
| 24F1.001 | 12486-1 | 5.45E+06 | 1.87E-04 | 3.44E-11 | 34.8 |
| 29E10 | 12484-1 | 5.20E+06 | 1.64E-04 | 3.15E-11 | 27.0 |
| 31B3.001 | 12485-1 | 1.82E+06 | 4.17E-03 | 2.29E-09 | 23.6 |

Table 19 human CD112R (N81D) Binding Characterization

| Alias | Bionet # | $k_a$ (1/Ms) | $k_d$ (1/s) | $K_D$ (M) | R_max (RU) |
|---|---|---|---|---|---|
| 1E1.016 | 8429-3 | 5.26E+06 | 1.32E-03 | 2.50E-10 | 22.1 |
| 11F4 | 8473-4 | 1.94E+06 | 1.63E-03 | 8.41E-10 | 32.9 |
| 24F1 | 12483-1 | 4.82E+06 | 2.44E-04 | 5.06E-11 | 28.8 |
| 24F1.001 | 12486-1 | 4.48E+06 | 2.66E-04 | 5.94E-11 | 33.8 |
| 29E10 | 12484-1 | 5.04E+06 | 6.37E-04 | 1.26E-10 | 25.7 |
| 31B3.001 | 12485-1 | 1.82E+06 | 4.38E-03 | 2.40E-09 | 22.5 |

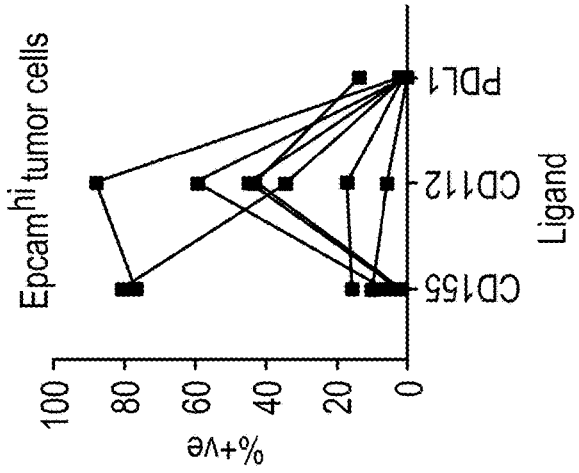
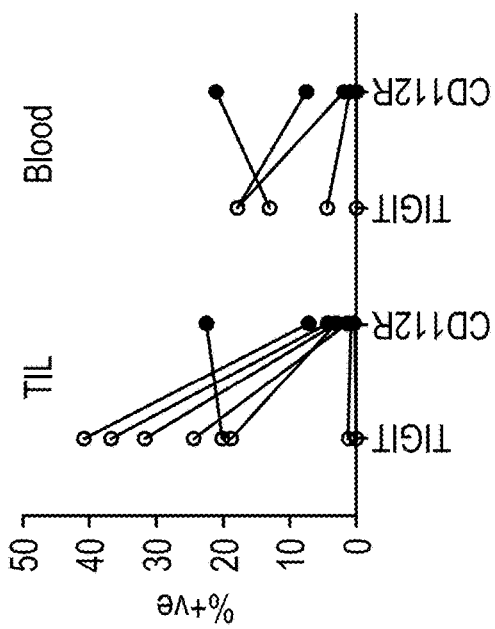
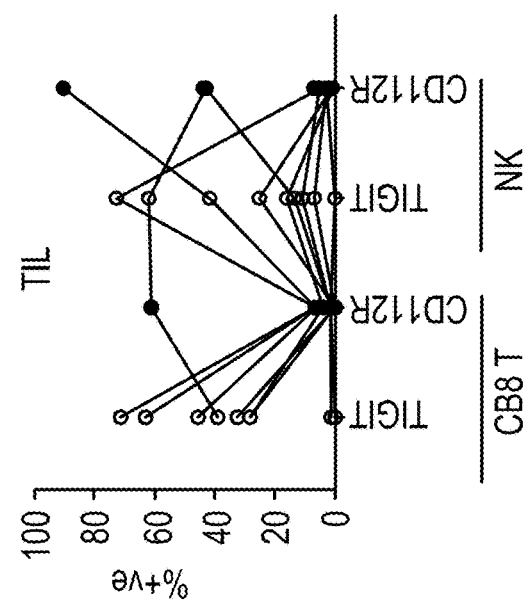

Tumor cell killing

IFNg induction

CT26

B16F10

Xenograft

SEC %HMW -30°C

SEC %HMW 4°C

SEC %HMW 25°C

SEC %HMW 40°C

SEC %Mean Peak -30°C

SEC %Mean Peak 4°C

SEC %Mean Peak 25°C

SEC %Mean Peak 40°C

FIG. 26

TABLE 28

| Candidate | Corrected Relative Area LMW+MMW Peak |||||||||||
|---|---|---|---|---|---|---|---|---|---|---|---|
| | T0 | 1 wk ||| 2 wk ||| FT 5x | (-30C) | 4 wk |||
| | | 4C | 25C | 40C | 25C | 40C | FT 5x | | 4C | 25C | 40C |
| | | | | | | | | | | | |
| CD112R - 140mgml | 0.0 | 0.0 | 0.2 | 0.3 | 0.0 | 0.0 | 0.0 | 0.1 | 0.1 | 0.2 | 1.0 |
| TIGIT-10 - 140mgml | 0.0 | 0.0 | 0.3 | 0.2 | 0.1 | 0.7 | 0.0 | 0.2 | 0.0 | 0.3 | 1.5 |
| TIGIT-12 - 140mgml | 2.3 | 2.2 | 3.0 | 2.9 | 3.2 | 3.1 | 2.2 | 2.1 | 2.5 | 3.9 | 3.6 |
| CD112R - 70mgml | 0.0 | 0.0 | 0.1 | 0.3 | 0.3 | 0.1 | 0.0 | 0.1 | 0.0 | 0.2 | 0.9 |
| TIGIT-10 - 70mgml | 0.0 | 0.0 | 0.5 | 0.2 | 0.1 | 0.9 | 0.1 | 0.3 | 0.1 | 0.3 | 1.4 |
| TIGIT-12 - 70mgml | 2.1 | 2.3 | 2.7 | 2.9 | 3.1 | 3.0 | 2.2 | 2.1 | 2.2 | 3.5 | 3.5 |
| CD112R+TIGIT-10 1to1 | 0.0 | 0.1 | 0.3 | 0.5 | 0.2 | 0.8 | 0.1 | 0.1 | 0.1 | 0.1 | 1.2 |
| CD112R+TIGIT-12 1to1 | 0.0 | 1.1 | 1.4 | 1.4 | 1.2 | 1.7 | 1.1 | 1.1 | 1.2 | 1.5 | 2.1 |

TIGIT AND CD112R BLOCKADE

CROSS REFERENCE TO RELATED APPLICATIONS

The benefit under 35 U.S.C. § 119(e) of U.S. Provisional Application No. 63/052,011, filed Jul. 15, 2020, and U.S. Provisional Application No. 63/212,315, filed Jun. 18, 2021, is hereby claimed, and the disclosure thereof is hereby incorporated by reference herein.

INCORPORATION BY REFERENCE OF MATERIAL SUBMITTED ELECTRONICALLY

Incorporated by reference in its entirety is a computer-readable nucleotide/amino acid sequence listing submitted concurrently herewith and identified as follows: 5.22 MB ASCII (Text) file named "A-2443-US-NP_Seq_Listing.txt"; created on Jun. 28, 2021.

BACKGROUND

The PD-1/PD-L1 axis is involved in the suppression of T cell immune responses in cancer. Antagonists of this pathway have been clinically validated across a number of solid tumor indications. Nivolumab and pembrolizumab are two such inhibitors that target the PD-1 pathway, and each has been approved by the U.S. Food and Drug Administration (FDA) for the treatment of metastatic melanoma. Recently, researchers have tested the paradigm of checkpoint inhibition in the setting of other tumor types. While some advances have been made, checkpoint inhibition therapy still remains in the shadows of other cancer treatment options.

Studies of checkpoint inhibitors in combination with other agents are underway or recently have been completed. The combination of nivolumab and ipilimumab, a CTLA-4 receptor blocking antibody, for example, was tested in a Phase III clinical trial on patients with unresectable stage III or IV melanoma. In this study, the percentage of patients achieving a complete response was the highest among those that received the combination of nivolumab and ipilimumab, beating the outcome exhibited by those in the group receiving either drug alone. However, the response to immunotherapies that block CTLA-4 and PD-1 checkpoint receptors is not universal, and multiple mechanisms by which tumors evade response have been identified. As an approach to enhance the overall efficacy and to limit tumor resistance, combination therapies targeting multiple pathways represent a rationale next step.

There is a need for safe and effective combination therapies targeting multiple checkpoint inhibitor pathways.

SUMMARY

Presented herein are data demonstrating the induction of TIGIT and CD112R on activated human T cells and TILs (tumor infiltrating leukocytes) in primary human tumor tissues as well as data supporting the high co-expression levels of the ligands of TIGIT and CD112R (CD155 and CD112) on tumor cells. The data provided herein support that, while blocking the single interaction of TIGIT or CD112R with its ligand enhances primary human T cell activity, the simultaneous blockade of both receptors (TIGIT and CD112R) from binding to their respective ligands greatly enhances primary human T cell activity. The data furthermore support that blockade of yet a third interaction involving PD-1 and its ligand, in addition to the blockade of TIGIT and CD112R interactions, significantly increases the overall primary human T cell activity. The increase in activity achieved with the blockade of all three molecules (PD-1, TIGIT, CD112R) is beyond that achieved with single blockade (TIGIT only or CD112R only) and double blockade (blockade of both TIGIT and CD112R, both TIGIT and PD-1, or both CD112R and PD-1).

Accordingly, the present disclosure provides TIGIT antigen binding proteins (e.g., antibodies and antigen binding fragments thereof), CD112R antigen binding proteins (e.g., antibodies and antigen binding fragments thereof), and combinations thereof. Compositions comprising TIGIT antigen binding proteins, CD112R antigen binding proteins and PD-1 antigen binding proteins are furthermore provided by the present disclosure. In certain embodiments, the compositions comprise a TIGIT antibody or TIGIT-binding fragment thereof and/or a CD112R antibody or CD112R-binding fragment thereof, and/or a PD-1 antibody or PD-1 binding fragment thereof. In preferred embodiments, the composition comprises a TIGIT antibody and a CD112R antibody. Related conjugates, fusion proteins, nucleic acids, vectors, host cells and kits are provided herein.

The present disclosure also provides pharmaceutical compositions comprising a TIGIT antigen binding protein, CD112R antigen binding protein, or combinations thereof, optionally, further comprising a PD-1 antigen binding protein, or a conjugate, fusion protein, nucleic acid, vector, or host cell, and a pharmaceutically acceptable carrier, diluent, or excipient. In preferred embodiments, the pharmaceutical composition comprises a 1:1 ratio of a TIGIT antibody and a CD112R antibody.

Methods of making the antigen binding proteins are provided. Also, methods of treating subjects in need thereof, comprising administering to the subject a pharmaceutical composition of the present disclosure, are provided.

BRIEF DESCRIPTION OF THE DRAWINGS

FIG. 1A which comprises FIGS. 1A-1 to 1A-4 is a series of plots depicting co-expression profiles of cells of the indicated tumor indication. In the top row, co-expression of TIGIT family members with each other and with PD-1 is shown. In the bottom row, co-expression of ligands of the TIGIT family members with each other and with PD-1 is shown.

FIG. 3 is a schematic of the screening cascade utilized to discover anti-CD112R antagonist antibodies.

FIG. 5A is a table listing characteristics of Harvests 1-3 and FIG. 5B is a table listing characteristics of Harvests 6-9.

FIG. 7B is a table listing exemplary EC50 values of the indicated antibodies and germline and HC CDR3 sequence information.

FIG. 9A is a graph of the signal during the different stages of the competition assay for three scenarios: A2, B2, and F2, wherein A2 is when two different antibodies are used to determine if the second antibody competes with the first antibody for binding to ligand. B2 is when the same antibody is used as throughout the assay. F2 is when an irrelevant control antibody is used.

FIG. 9B is a table listing antibodies that compete with each other (Bin A) for binding to ligand, as determined by the competition assay.

Cultured human T cells and cyno PBMCs were incubated with antibodies at varying concentrations starting at 3 µg/mL (in assay with human T cells) or 5 µg/mL (in assay with cyno PBMCs). The antibodies were titrated 1 in 3 for the lowest concentration of 0.001 µg/mL (in assay with human T cells) and 0.002 µg/mL (in assay with cyno PBMCs). FCS Express was used to obtain Geo Means and Screener was used to determine fold over Isotype control, titration curves and EC50 values.

Each of FIGS. 17A-17C is a graph of the IFNγ released in the presence of the indicated combinations of antibodies of 2 or three antibodies or single antibody. 3×=combination of anti-PD-1, anti-TIGIT and anti-CD112R antibodies.

FIG. 18 is a compilation of Tables 2-5 and 12-19 referenced herein.

Figure 19B:
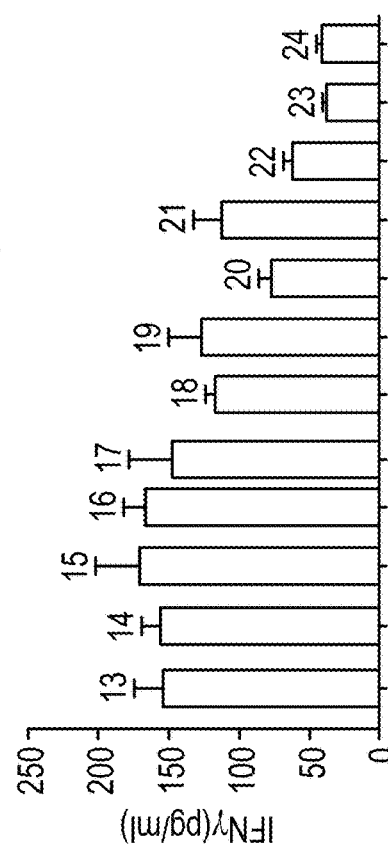
Figure 19A:
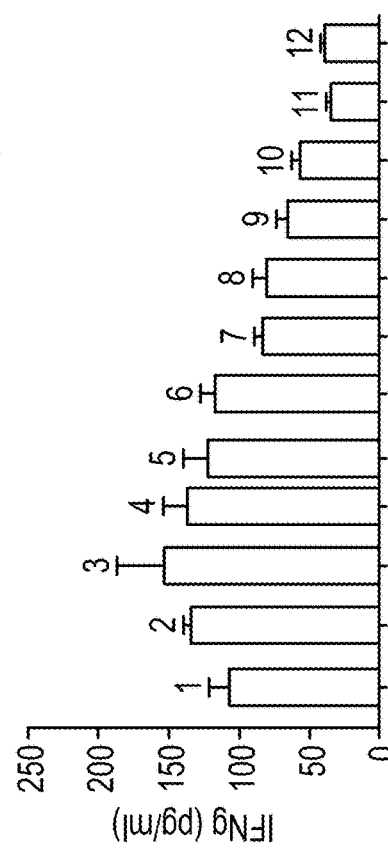

Each of FIGS. 19A and 19B is a graph of the amount of IFN-γ (pg/mL) produced by cytotoxic T lymphocytes upon stimulation with a formulation comprising anti-CD112R mAb (24F1), anti-TIGIT mAb (43B7.002.015) and anti-PD-1 mAb at varying ratios as indicated. The total antibody concentration of the formulations in FIGS. 19A and 19B is 1.5 nM and 30 nM, respectively.

FIGS. 20A-20C are graphs relating to the expression of TIGIT, CD112R, and the ligands CD155, CD112, and PDL1 by ex vivo primary human tumor tissues and matching blood, as determined by FACS analysis. The percentages of TIGIT+ and CD112R+ cells on CD8+ T cells and CD3−CD56+ NK cells among CD45+ immune cells in dissociated tumor tissues are graphed in FIG. 20A, and the percentages of TIGIT+ and CD112R+ cells expressed by combined T/NK among tumor infiltrating lymphocytes (TIL) or blood are shown in FIG. 20B. Ligand expression was analyzed on a subset of the samples, for which the percentages of CD155−, CD112−, and PD-L1-positive cells in EpcamHI tumor cells are shown in FIG. 20C. The connecting lines indicate values from individual donors. These data represent combined results from tumor tissues from four indications (PANC, CRC, GIST, and TNBC).

Figure 21:
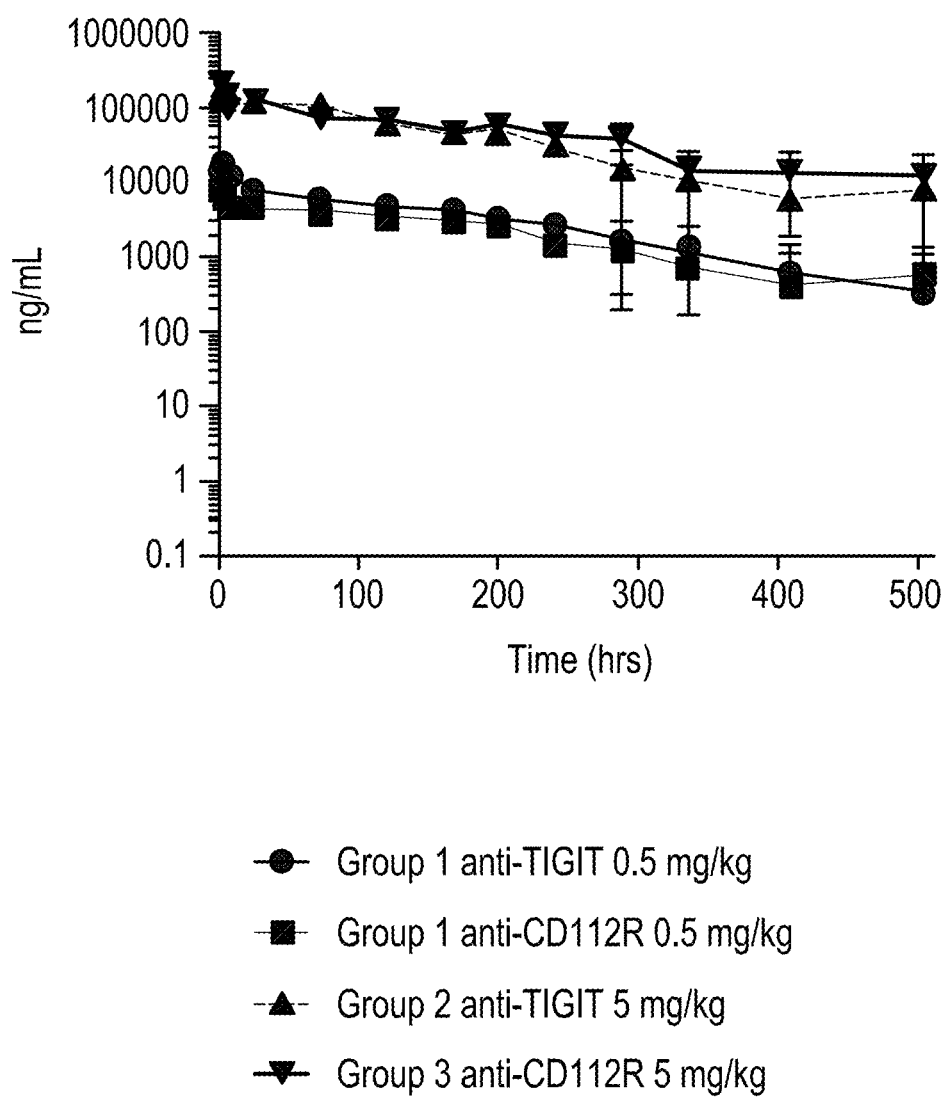

FIG. 21 is a graph of the mean serum mAb concentration plotted as a function of time post IV administration to male cynomolgus monkeys. The line with circles plots the mean serum concentration of anti-TIGIT mAb of Group 1 animals, the line with squares plots the mean serum concentration of anti-CD112R mAb of Group 1 animals, the line with triangles (pointing up) plots the mean serum concentration of anti-TIGIT mAb of Group 2 animals, and the line with triangles (pointing down) plots the mean serum concentration of anti-CD112R mAb of Group 3 animals.

Figure 22A:
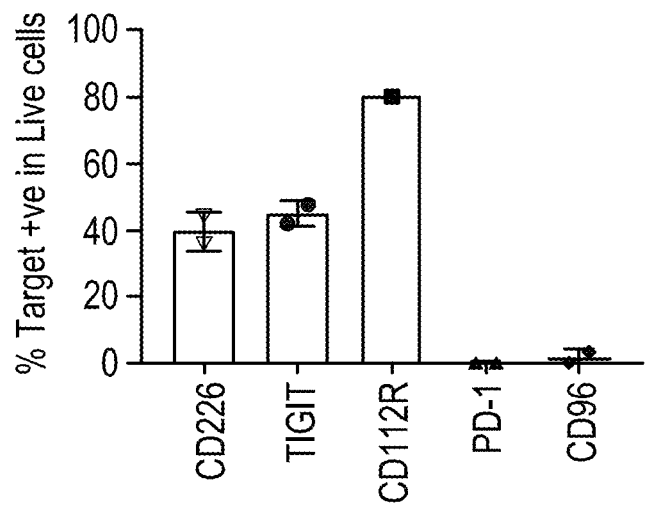
Figure 22B:
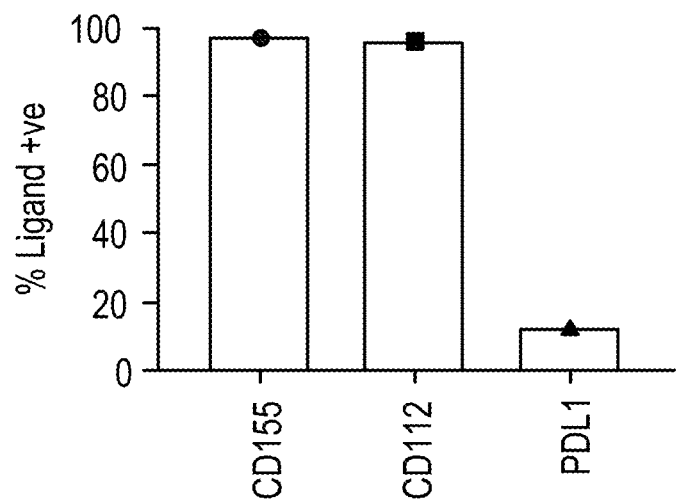
Figure 22C:
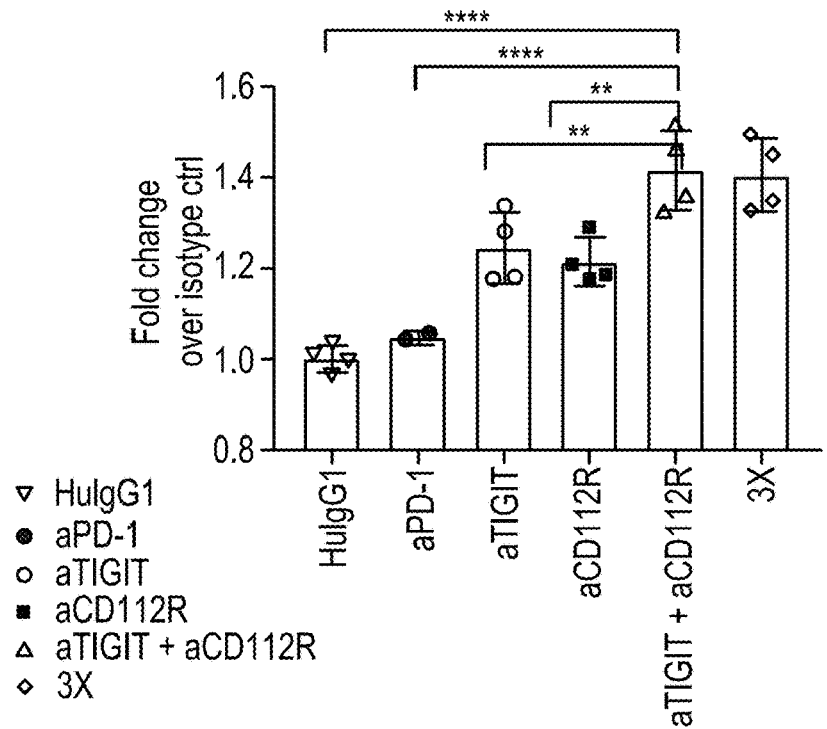
Figure 22D:
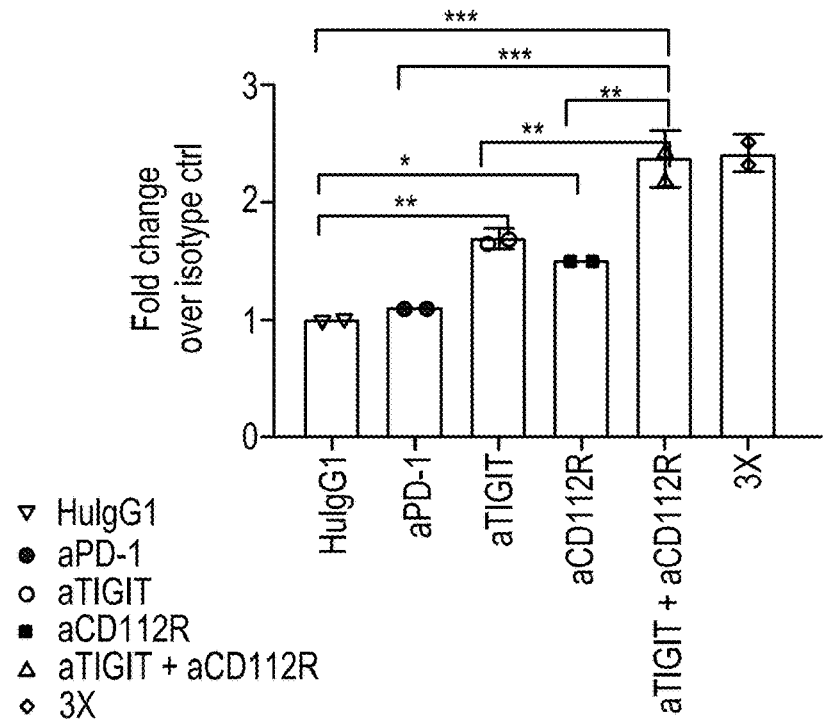

FIGS. 22A-22D demonstrate CD112R+TIGIT blockade additively enhances human primary NK cell activity against tumor cells. FIG. 22A is a graph of the % target positive NK cells where targets are CD226, TIGIT, CD112R, PD-1 or CD96, showing that purified human NK cells express high levels of CD226, TIGIT, and CD112R and low levels of PD-1 and CD96. FIG. 22B is a graph of the % ligand-positive cells expressing CD155, CD112, or PDL1 and shows target tumor cells used in the assay (SKBR3 tumor cell line) express high levels of CD155 and CD112 and a low level of PD-L1. FIG. 22C is a graph of the extent of tumor cell killing (relative to isotype control antibody) by the purified human NK cells stimulated by anti-PD-1 antibody, anti-TIGIT antibody, anti-CD112R antibody, or a combination of anti-TIGIT antibody and anti-CD112R antibody, or a combination of anti-PD-1 antibody, anti-TIGIT antibody, and anti-CD112R antibody (3×). FIG. 22D is a graph of the extent of IFNγ production (relative to isotype control antibody) stimulated by the indicated antibody mixtures comprising anti-PD-1 antibody, anti-TIGIT antibody, anti-CD112R antibody, or a combination of anti-TIGIT antibody and anti-CD112R antibody, or a combination of anti-PD-1 antibody, anti-TIGIT antibody, and anti-CD112R antibody (3×). FIGS. 22C and 22D show that individual blockade of TIGIT or CD112R enhanced NK cell activity compared to isotype (HuIgG1) or PD-1 antibody-treated cells, but the blockade of both TIGIT and CD112R additively enhanced both tumor cell killing and IFNg production at 16 hrs. NK cell activity is shown as fold change over isotype control. Each mAb was added at 10 ug/ml.

Figure 23:
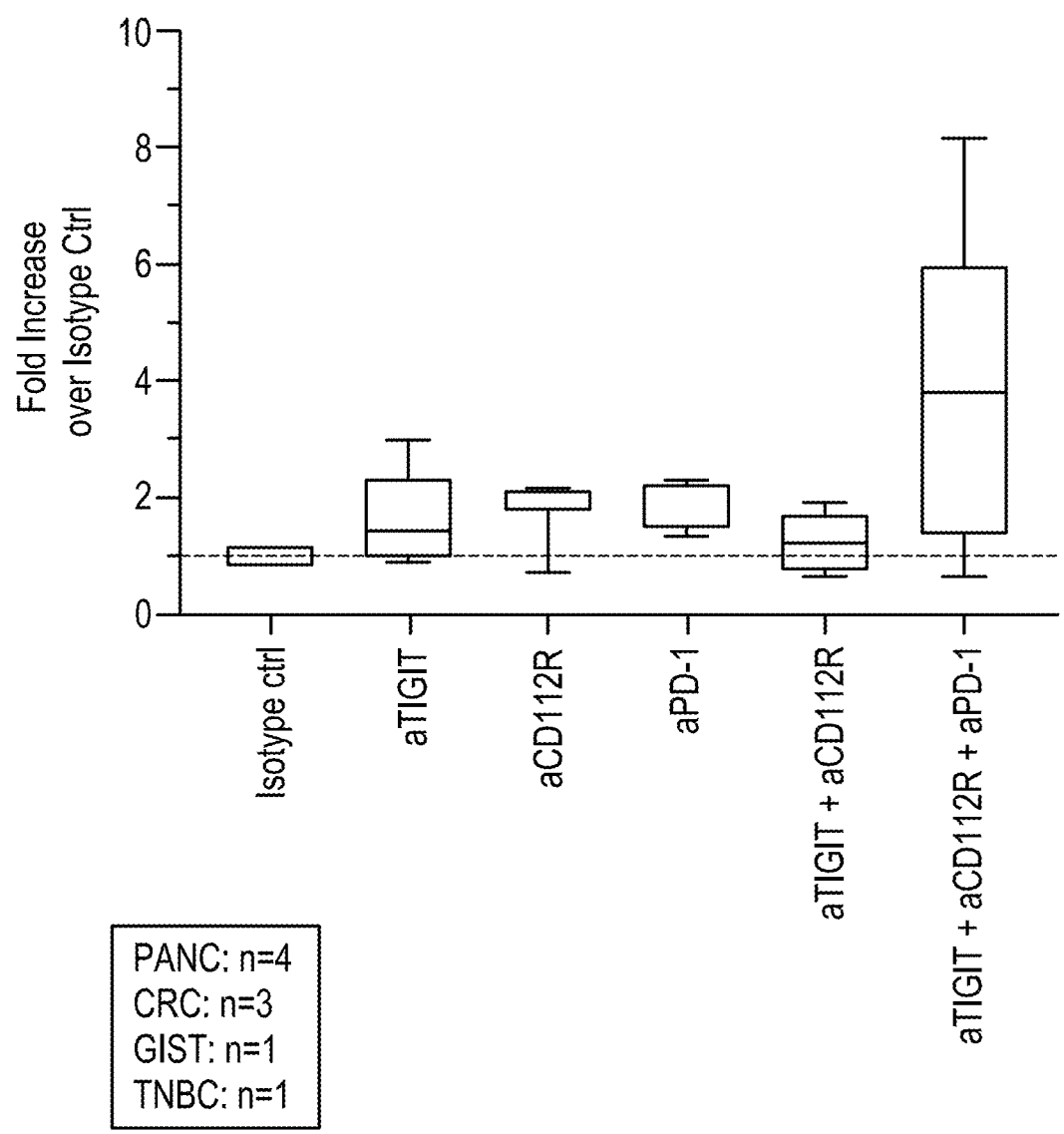

A single cell suspension generated from dissociated ex vivo tumor tissue was cultured in the presence of the indicated antibody mixtures comprising anti-PD-1 antibody, anti-TIGIT antibody, anti-CD112R antibody, or a combination of anti-TIGIT antibody and anti-CD112R antibody, or a combination of anti-PD-1 antibody, anti-TIGIT antibody, and anti-CD112R antibody (10 ug/ml each) and T/NK cell activity was measured by IFNg levels in the supernatant on day 3. FIG. 23 is a graph of the increase (relative to isotype control antibody) in primary TIL response in dissociated ex vivo tumor tissue, showing that the mixture comprising all three antibodies targeting CD112R+TIGIT+PD-1 at a ratio of 1:1:1 stimulates the highest TIL response. The average values from 5 different tissues and error bars indicating SEM are shown in this graph.

Figure 24A:
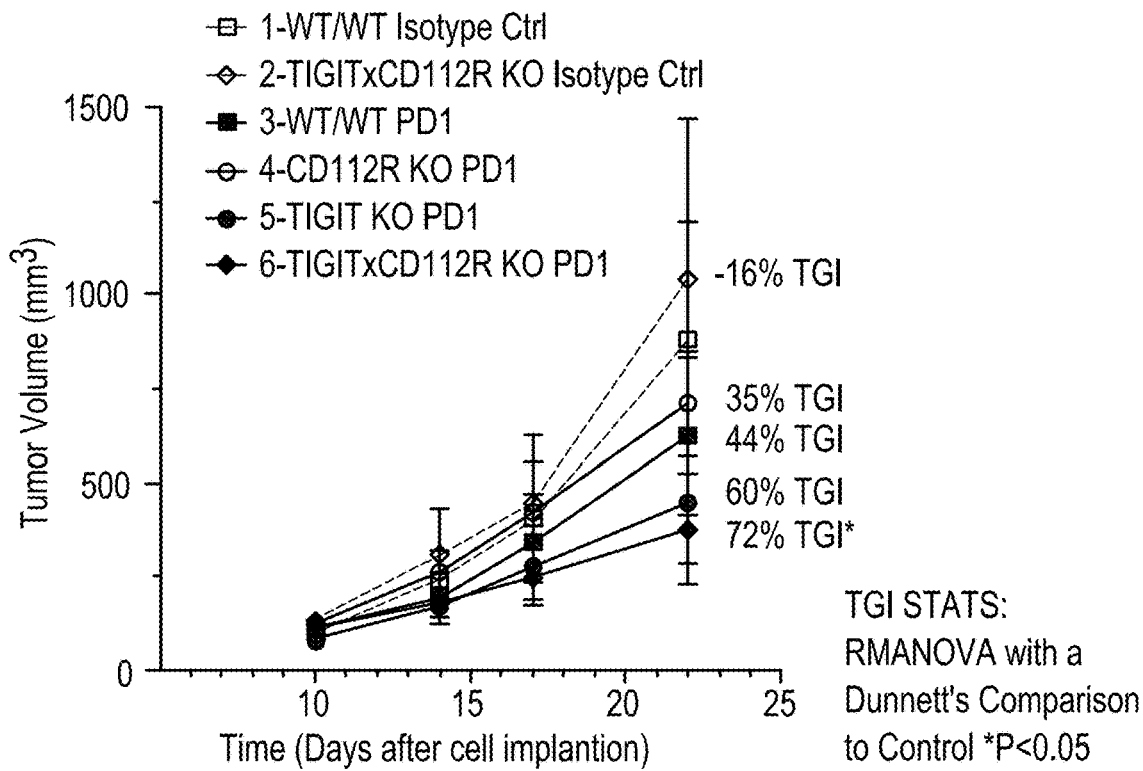
Figure 24B:
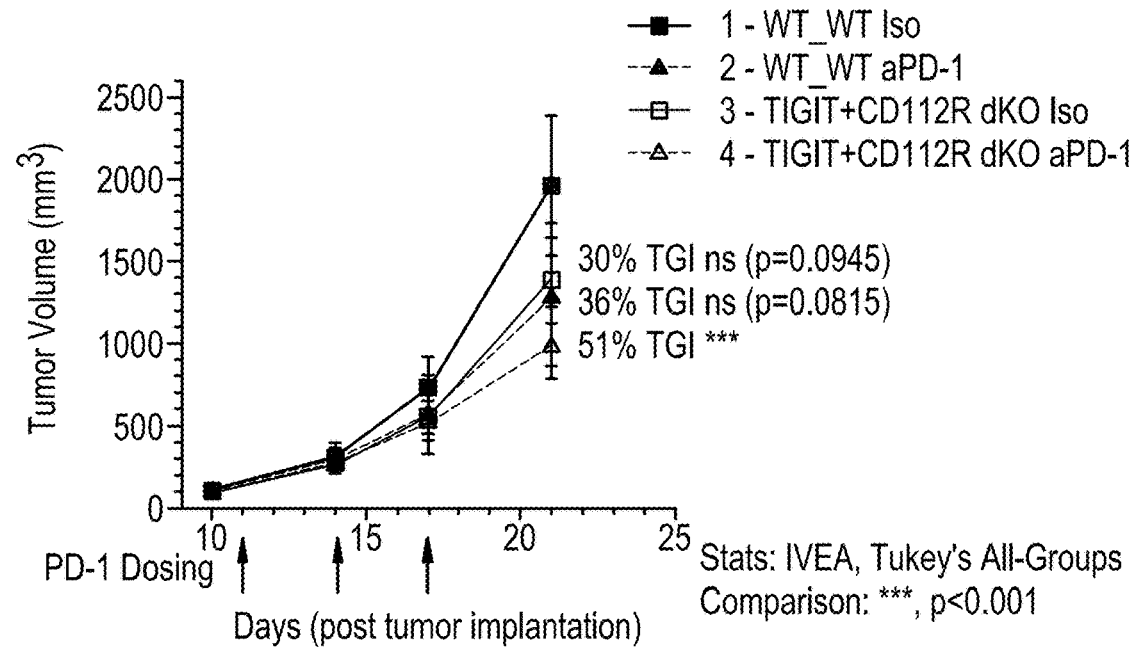
Figure 24C:
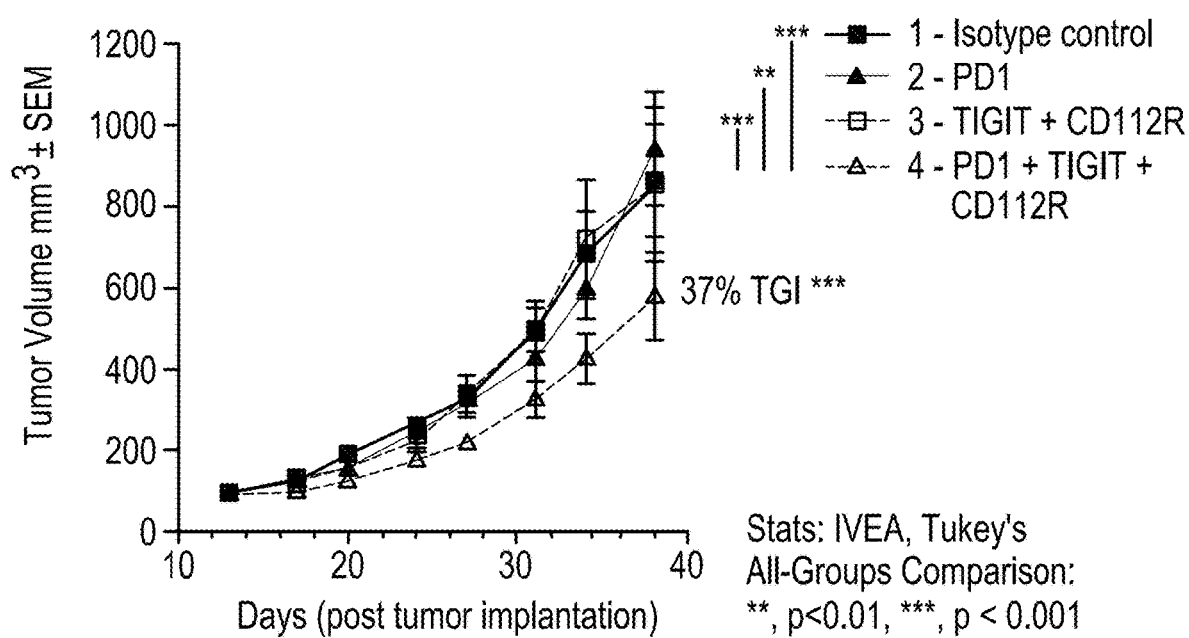
Figure 25A:
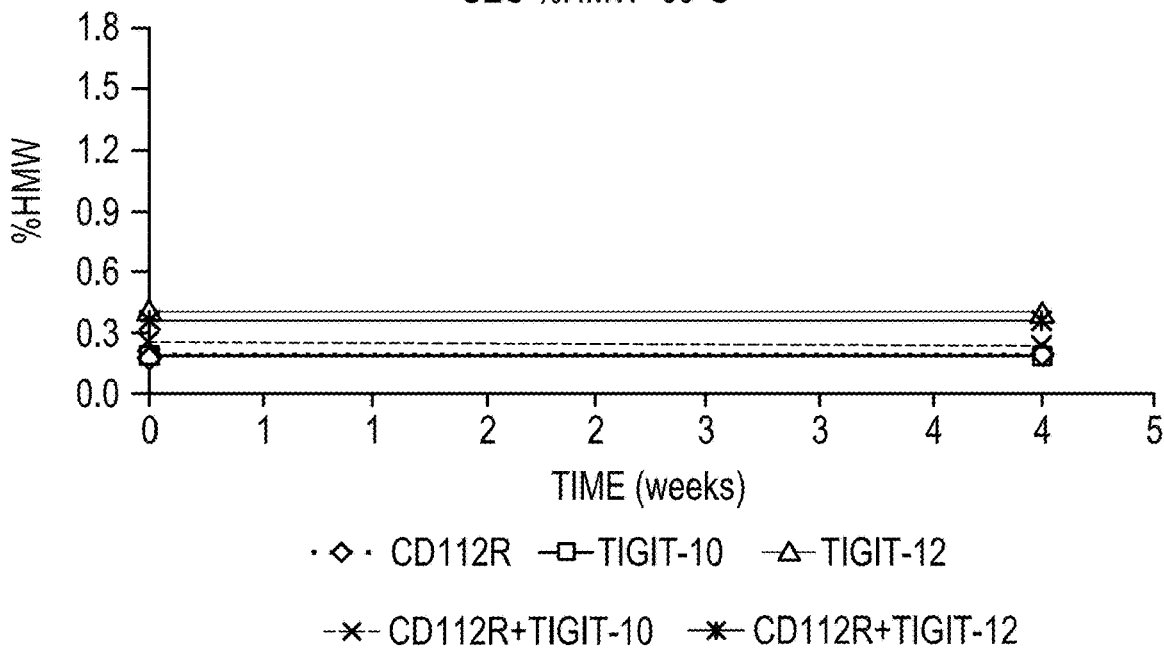
Figure 25B:
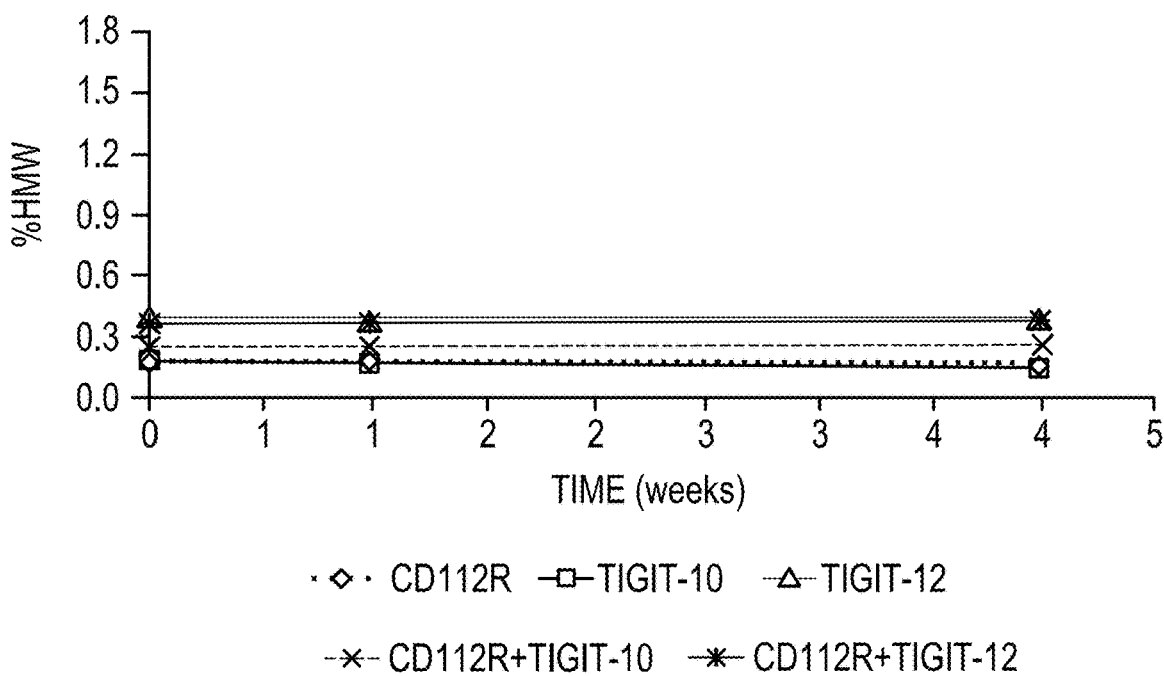
Figure 25C:
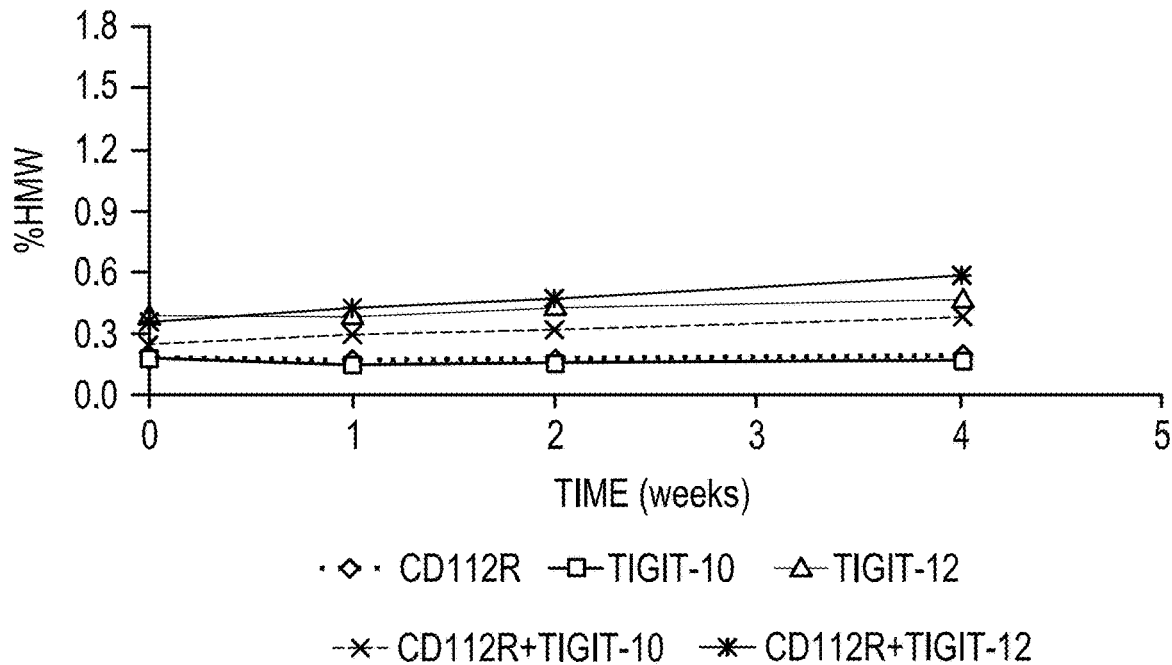
Figure 25D:
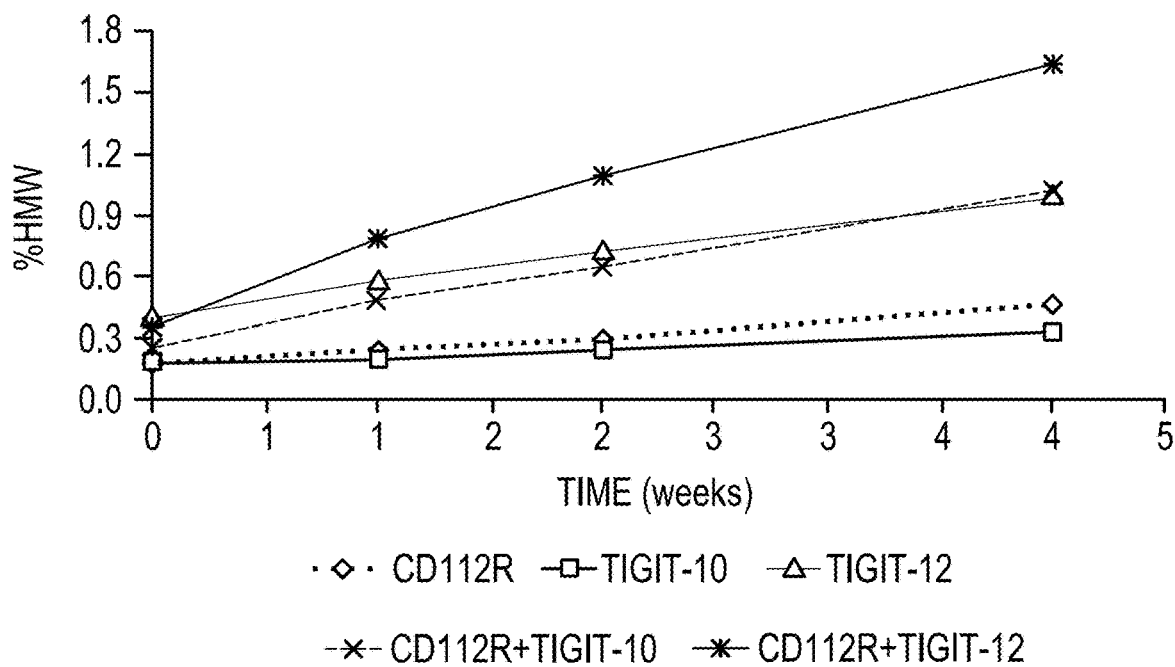
Figure 25E:
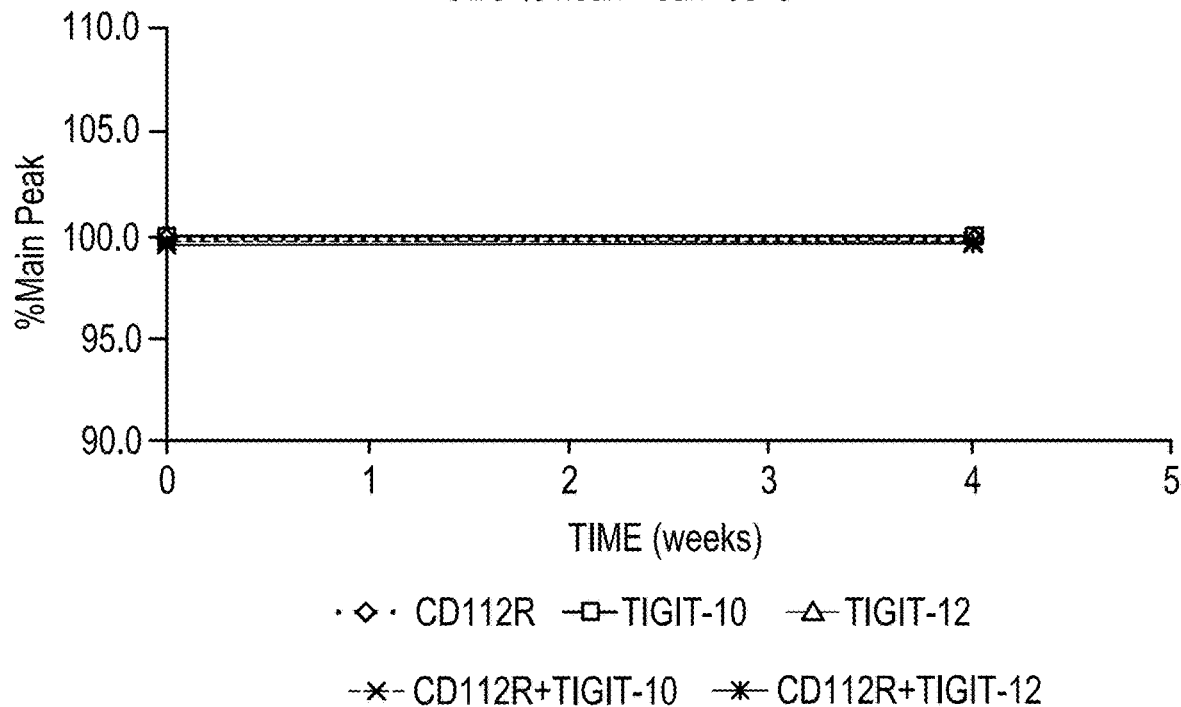
Figure 25F:
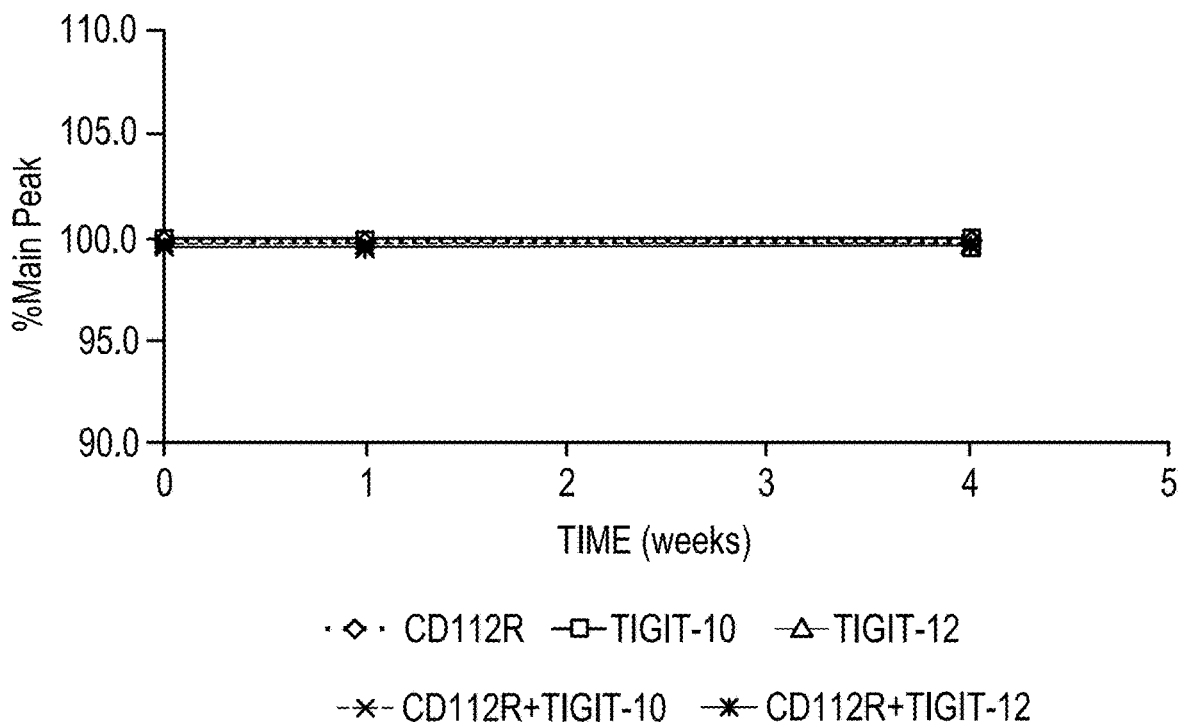
Figure 25G:
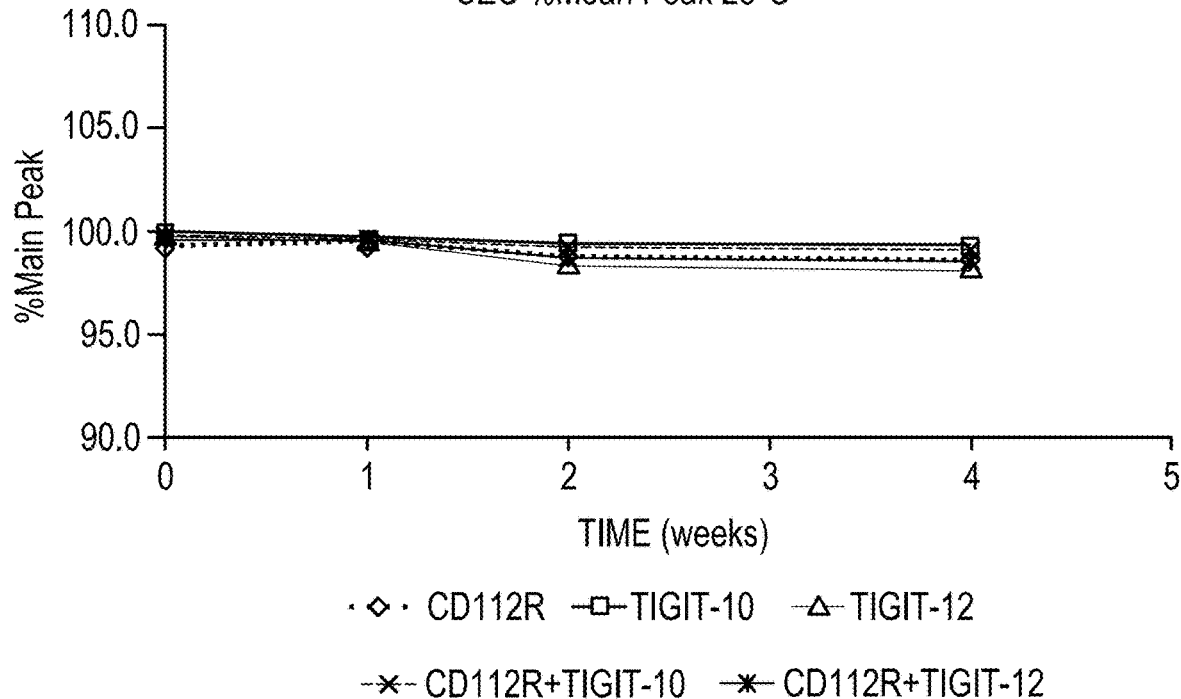
Figure 25H:
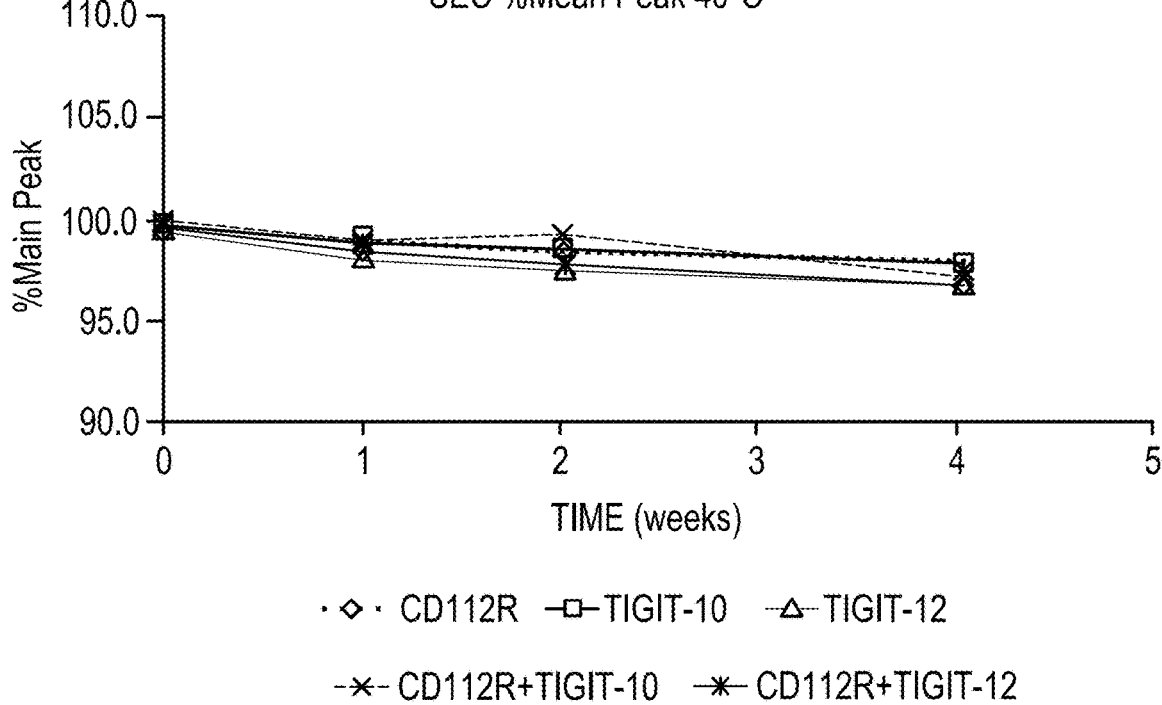

FIGS. 24A-24C represent graphs of the tumor growth response over time in several different mouse tumor models. FIG. 24A shows tumor growth in CT26 syngeneic tumor model, where tumor volume is plotted as a function of days post tumor implantation in wildtype (WT) mice, TIGIT×CD112R KO (double KO) mice, CD112R KO mice, or TIGIT KO mice, that were treated with isotype control or anti-PD1 antibody. The numbered groups correspond to (1) WT mice treated with an isotype control antibody, (2) TIGIT×CD112R KO mice treated with an isotype control antibody, (3) WT mice treated with anti-PD-1 antibody, (4) CD112R KO mice treated with anti-PD-1 antibody, (5) TIGIT KO mice treated with anti-PD-1 antibody and (6) TIGIT×CD112R KO mice treated with anti-PD-1 antibody. FIG. 24B is a graph of the tumor volume in B16F10 syngeneic tumor model where group numbers correspond to (1) WT mice treated with an isotype control antibody, (2) WT mice treated with an anti-PD-1 antibody, (3) TIGIT×CD112R KO (dKO) mice treated with an isotype control antibody, and (4) TIGIT×CD112R KO (dKO) mice treated with anti-PD-1 antibody. FIG. 24C is a graph of the tumor volume measured over time in a xenograft model treated with (1) isotype control antibody, (2) anti-PD-1 antibody, (3) a combination formulation comprising anti-TIGIT mAb and anti-CD112R mAb, and (4) a combination formulation comprising anti-TIGIT mAb and anti-CD112R mAb and an anti-PD-1 mAb.

Each of FIGS. 25A-25H is a graph of the % high molecular weight (HMW) species (FIGS. 25A-25D) or % antibody main peak (FIGS. 25E-25H) plotted as a function of time (weeks) measured in a formulation comprising (1) anti-CD112R mAb (CD112R), (2) anti-TIGIT mAb (TIGIT-10), (3) another anti-TIGIT mAb (TIGIT-12), (4) both anti-CD112R mAb and TIGIT-10 mAb and (5) both anti-CD112R mAb and TIGIT-12 after storage at −30° C. (FIGS. 25A and 25E), 4° C. (FIGS. 25B and 25F), 25° C. (FIGS. 25C and 25G) and 40° C. (FIGS. 25D and 25H), as measured by SEC.

FIG. 26 is a table listing the % LMW+HMW peaks of formulations comprising 70 mg/mL or 140 mg/mL anti-CD112R mAb, TIGIT-10, or TIGIT-12, or a formulation comprising both anti-CD112R and TIGIT-10 at a 1:1 ratio or comprising both anti-CD112R and TIGIT-12 at a 1:1 ratio.

Figure 27:
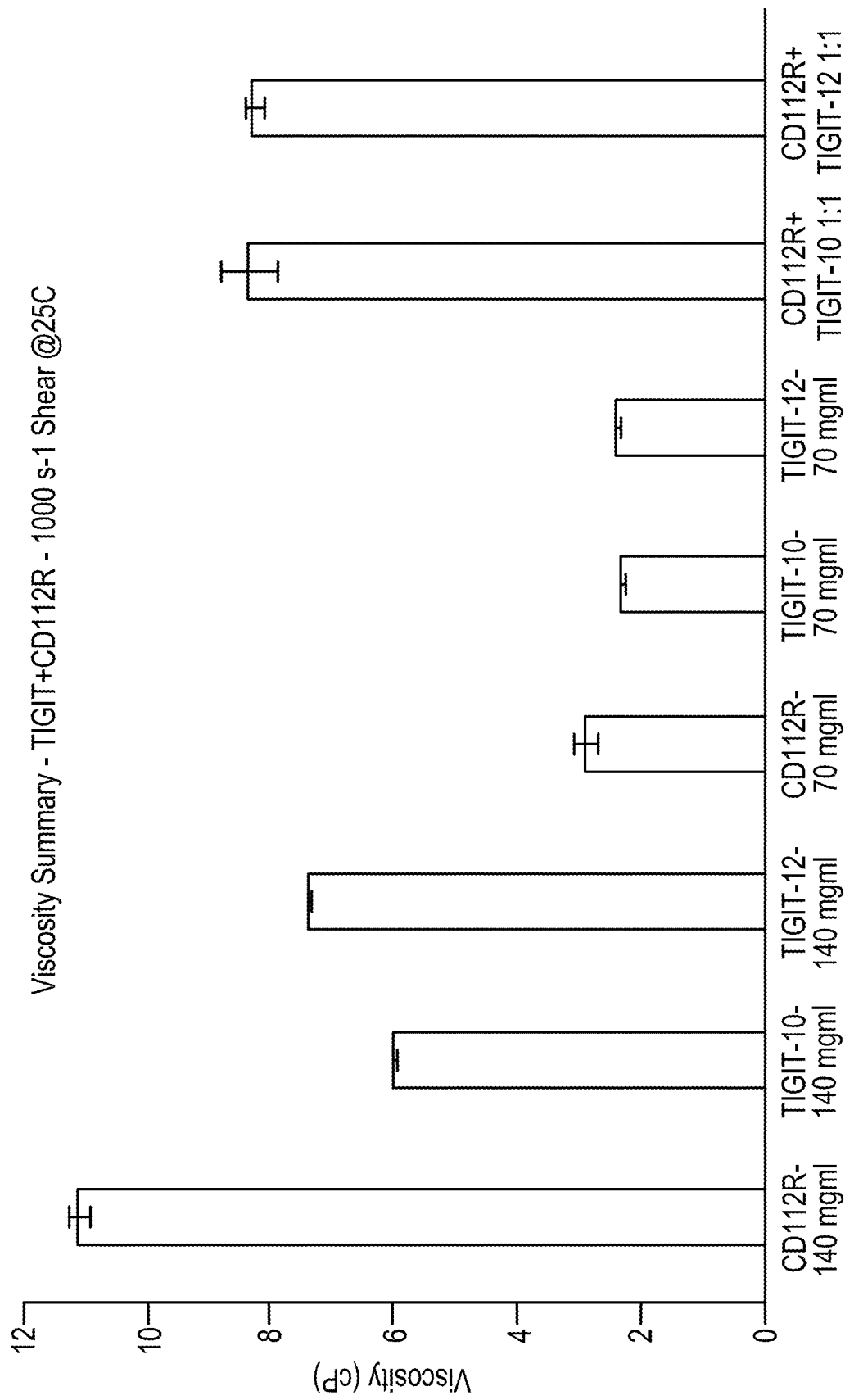

FIG. 27 is a graph of the viscosity (cP) of formulations comprising 70 mg/mL or 140 mg/mL anti-CD112R mAb, TIGIT-10, or TIGIT-12, or a formulation comprising both anti-CD112R and TIGIT-10 at a 1:1 ratio or comprising both anti-CD112R and TIGIT-12 at a 1:1 ratio.

DETAILED DESCRIPTION

TIGIT and CD112R (also known as PVRIG) belong to a family of receptors that contain immunoglobulin (Ig) domain(s) in the extracellular region. These receptors interact with ligands that also contain Ig domain(s). Although there is evidence that each receptor can interact with multiple ligands in the family, TIGIT-CD155 and CD112R-CD112 represent the primary receptor-ligand pairings based on the rank order by affinity measurements. Another family member, CD226, can interact with both CD112 and CD155, both with weaker affinity than that for TIGIT-CD155 and CD112R-CD112. Engagement of CD226 enhances T/NK cell activity specifically in the context of T/NK cell response to tumor cells. This "costimulatory" signal is thought to be inhibited when TIGIT and CD112R are co-expressed at high levels, because 1) TIGIT and CD112R both bind to the ligands at higher affinities than does CD226 and effectively limit ligand accessibility and 2) TIGIT and CD112R intracellular domains contain ITIM or ITIM-like domains that are thought to generate inhibitory signals, although the nature of such signal has not been extensively characterized in T cells.

Transcripts of CD155 and CD112, the primary ligands for TIGIT and CD112R, are present in a wide range of tissues and cell types. This contrasts with PD-L1, whose expression is more restricted, with preferential expression in antigen presenting cells and tumor cells. These ligands have been shown to be induced by different types of stimuli: while PD-L1 is upregulated by exposure to IFNγ, CD155 and CD112 are not regulated by exposure to this cytokine and are instead upregulated in response to DNA damage, viral infection, and reactive oxygen species (ROS). Therefore, ligand induction response further differentiates the pathways engaged by TIGIT and CD112R from that by PD-1.

The present disclosure provides antigen binding proteins, e.g., antibodies and antigen-binding fragments thereof, that bind to TIGIT, e.g., TIGIT binding proteins, also referred herein as TIGIT antigen binding proteins. In preferred embodiments, the TIGIT antigen binding protein is an antibody that specifically binds TIGIT (e.g., a TIGIT antibody, an α-TIGIT antibody).

The present disclosure additionally provides antigen binding proteins which bind to CD112R, e.g., CD112R binding proteins, also referred herein as CD112R antigen binding proteins. In preferred embodiments, the CD112R antigen binding protein is an antibody that specifically binds CD112R ((e.g., a CD112R antibody, an α-CD112R antibody)).

Binding Characteristics

In exemplary embodiments, the binding strength of the presently disclosed TIGIT antigen binding protein for binding to TIGIT is described in terms of its affinity. In exemplary aspects, the binding strength of the presently disclosed TIGIT antigen binding protein for TIGIT is described in terms of $K_D$. Likewise, the binding strength of the presently disclosed CD112R antigen binding protein for binding to CD112R is described in terms of its affinity, and, in exemplary aspects, the binding strength of the presently disclosed CD112R antigen binding protein for CD112R is described in terms of $K_D$. $K_D$ is the equilibrium dissociation constant, a ratio of $k_{off}/k_{on}$, between an antigen binding protein and its target or antigen. $K_D$ is inversely proportional to the affinity. The $K_D$ value relates to a concentration of the antigen binding protein, and thus the lower the $K_D$ value, the higher the affinity of the antigen binding protein. In exemplary aspects, the $K_D$ of the TIGIT antigen binding proteins and CD112R antigen binding proteins provided herein is micromolar, nanomolar, picomolar or femtomolar. In exemplary aspects, the $K_D$ of the TIGIT antigen binding proteins or the CD112R antigen binding proteins provided herein is within a range of about $10^{-4}$ to $10^{-6}$ M, or $10^{-7}$ to $10^{-9}$ M, or $10^{-10}$ to $10^{-12}$ M, or $10^{-13}$ to $10^{-15}$ M. Optionally, the $K_D$ of the TIGIT antigen binding proteins or the CD112R antigen binding proteins provided herein is within a range of about $10^{-12}$ to $10^{-8}$ M, optionally, $10^{-11}$ to $10^{-10}$ M.

In various aspects, the antigen binding protein, e.g., antibody, binds to human TIGIT. The amino acid sequence of human TIGIT is provided herein as SEQ ID NO: 1. In particular, amino acids 1-21 of SEQ ID NO: 1 represents the signal peptide, and amino acids 22-244 of SEQ ID NO: 1 represents the mature human TIGIT amino acid sequence. In exemplary aspects, the antigen binding protein binds to the human TIGIT with a $K_D$ that is about 50 nM or less (e.g., about 40 nM or less, about 30 nM or less, about 20 nM or less, or about 10 nM or less). In exemplary aspects, the antigen binding protein binds to the human TIGIT with a $K_D$ that is less than or about 5 nM, less than or about 4 nM, less than or about 3 nM, less than or about, 2 nM, or less than or about 1 nM. In various aspects, the $K_D$ of the antigen binding protein for human TIGIT is less than 1 nM, e.g., less than 0.75 nM, less than 0.5 nM, or less than 0.25 nM. Optionally, the $K_D$ of the antigen binding protein for human TIGIT is greater than or about 0.001 nM or greater than or about 0.01 nM and less than 0.5 nM. In various aspects, the $K_D$ of the antigen binding protein for human TIGIT is about 0.01 nM to about 0.5 nM, about 0.02 nM to about 0.5 nM, about 0.03 nM to about 0.5 nM, about 0.04 nM to about 0.5 nM, about 0.05 nM to about 0.5 nM, about 0.06 nM to about 0.5 nM, about 0.07 nM to about 0.5 nM, about 0.08 nM to about 0.5 nM, about 0.09 nM to about 0.5 nM, about 0.1 nM to about 0.5 nM, about 0.2 nM to about 0.5 nM, about 0.3 nM to about 0.5 nM, about 0.4 nM to about 0.5 nM, about 0.01 nM to about 0.4 nM, about 0.01 nM to about 0.3 nM, about 0.01 nM to about 0.2 nM, about 0.01 nM to about 0.1 nM, about 0.01 nM to about 0.09 nM, about 0.01 nM to about 0.08 nM, about 0.01 nM to about 0.07 nM, about 0.01 nM to about 0.06 nM, about 0.01 nM to about 0.05 nM, about 0.01 nM to about 0.04 nM, about 0.01 nM to about 0.03 nM, or about 0.01 nM to about 0.02 nM. In various aspects, the antigen binding protein also binds to cynomolgus monkey (cyno) TIGIT. The amino acid sequence of cyno TIGIT is provided herein as SEQ ID NO: 2024. In particular, amino acids 1-21 of SEQ ID NO: 2024 represents a signal peptide and amino acids 22-245 of SEQ ID NO: 2024 represents the mature cyno TIGIT protein. In exemplary aspects, the antigen binding protein binds to cynomolgus monkey TIGIT with a $K_D$ that is about 1 nM to about 25 nM, e.g., about 5 nM to about 20 nM, or about 5 nM to about 15 nM. In exemplary aspects, the antigen binding protein binds to cynomolgus (cyno) monkey TIGIT with a $K_D$ of about 8 nM to about 14 nM. In various aspects, the antigen binding protein binds with high affinity to both human TIGIT and cyno TIGIT. Optionally, the $K_D$ of the antigen binding protein for human TIGIT is about 0.01 nM and less than 0.5 nM and the $K_D$ of the antigen binding protein for cyno TIGIT is about 8 nM to about 14 nM. In exemplary instances, the $K_D$ of the antigen binding protein for human TIGIT is within about 100-fold, about 50-fold, about 25-fold, about 10-fold, about 5-fold, or about 2-fold, or less, of the $K_D$ of the antigen binding protein for cyno TIGIT. In various aspects, the EC50 value of the TIGIT antigen binding protein for human T-cells expressing human TIGIT is within about 100-fold, about 50-fold, about 25-fold, about 10-fold, about 5-fold, or about 2-fold, or less, of the EC50 value of the TIGIT antigen binding protein for cyno PBMCs expressing cyno TIGIT.

In various instances, the antigen binding protein, e.g., antibody, binds to human CD112R. The amino acid sequence of human CD112R is provided herein as SEQ ID NO: 3. In particular, amino acid 53 of SEQ ID NO: 3 represents the first amino acid of the extracellular domain. In exemplary aspects, the antigen binding protein binds with high affinity to both human CD112R and cyno CD112R. In exemplary aspects, the antigen binding protein binds to the human CD112R with a $K_D$ that is about 50 nM or less (e.g., about 40 nM or less, about 30 nM or less, about 20 nM or less, or about 10 nM or less). In exemplary aspects, the antigen binding protein binds to the human CD112R with a $K_D$ that is less than or about 5 nM, less than or about 4 nM, less than or about 3 nM, less than or about, 2 nM, or less than or about 1 nM. In various aspects, the $K_D$ of the antigen binding protein for human CD112R is less than 1 nM, e.g., less than 0.75 nM, less than 0.5 nM, or less than 0.25 nM. Optionally, the $K_D$ of the antigen binding protein for human CD112R is greater than or about 0.001 nM or greater than or about 0.01 nM and less than 3 nM. In various aspects, the $K_D$ of the antigen binding protein for human CD112R is about 0.01 nM to about 5 nM, about 0.05 nM to about 5 nM, about 0.10 nM to about 5 nM, about 0.5 nM to about 5 nM, about 1 nM to about 5 nM, about 2 nM to about 5 nM, about 3 nM to about 5 nM, about 4 nM to about 5 nm, about 0.01 nM to about 4 nM, about 0.01 nM to about 3 nM, about 0.01 nM to about 2 nM, about 0.01 nM to about 1 nM, about 0.01 nM to about 0.5 nM, about 0.01 nM to about 0.1 nM, or about 0.01 nM to about 0.05 nM. In various aspects, the antigen binding protein binds to cyno CD112R. The amino acid sequence of cyno CD112R is provided herein as SEQ ID NO: 2022 of which amino acid 53 is the first amino acid of the extracellular domain. In exemplary aspects, the antigen binding protein binds to cynomolgus monkey (cyno) CD112R with a $K_D$ that is about 1 nM to about 25 nM, e.g., about 5 nM to about 20 nM, or about 5 nM to about 15 nM. In exemplary aspects, the antigen binding protein binds to cyno CD112R with a $K_D$ of about 0.05 nM to about 0.15 nM. Optionally, the $K_D$ of the antigen binding protein for human CD112R is about 0.01 nM and less than 5 nM and the $K_D$ of the antigen binding protein for cyno CD112R is about 0.05 nM to about 0.15 nM.

In exemplary instances, the $K_D$ of the antigen binding protein for human CD112R is within about 100-fold, about 50-fold, about 25-fold, about 10-fold, about 5-fold, or about 2-fold, or less, of the $K_D$ of the antigen binding protein for cyno CD112R. In various aspects, the EC50 value of the CD112R antigen binding protein for human T-cells expressing human CD112R is within about 100-fold, about 50-fold, about 25-fold, about 10-fold, about 5-fold, or about 2-fold, or less, of the EC50 value of the CD112R antigen binding protein for cyno PBMCs expressing cyno CD112R.

In exemplary embodiments, the antigen binding protein, e.g., antibody, exhibits a binding affinity for its target (TIGIT or CD112R) which is increased relative to the binding affinity of the native interaction between TIGIT and CD155, TIGIT and CD112, or CD112R and CD112. The increase in binding affinity may be at least or about a 5% increase, at least or about a 10% increase, at least or about a 15% increase, at least or about a 20% increase, at least or about a 25% increase, at least or about a 30% increase, at least or about a 35% increase, at least or about a 40% increase, at least or about a 45% increase, at least or about a 50% increase, at least or about a 55% increase, at least or about a 60% increase, at least or about a 65% increase, at least or about a 70% increase, at least or about a 75% increase, at least or about a 80% increase, at least or about a 85% increase, at least or about a 90% increase, at least or about a 95% increase, relative to the binding affinity of human TIGIT for its ligand (CD155) or relative to the binding affinity of human CD112R for its ligand (CD112). In exemplary aspects, the antigen binding protein exhibits an increase which is about a 2-, 5-, 10-, 15-, 20-, 25-, 30-, 35-, 40-, 45-, 50-, 55-, 60-, 65-, 70-, 75-, 80-, 85-, 90-, 95-, 100-, 105-, 110-, 115-, 120-, 125-, 130-, 135-, 140-, 145-, 150-, 175-, 200-, 225-, 250-, 275-, 300-, 325-, 350-, 375-, 400-, 425-, 450-, 475-, 500-, 525-, 550-, 575-, 600-, 625-, 650-, 675-, 700-, 725-, 750-, 775-, 800-, 825-, 850-, 875-, 900-, 925-, 950-, 975-fold, 1000-fold, or more increase in binding affinity for its target (TIGIT or CD112R) relative to the binding affinity of human TIGIT for human CD155 or the binding affinity of human CD112R for human CD112.

Competition Assays

In various embodiments, the antigen-binding protein, e.g., antibody, inhibits a binding interaction between human TIGIT and a reference antibody, which reference antibody is known to bind to TIGIT but is not an antigen-binding protein of the present disclosure. In various instances, the TIGIT-binding proteins of the present disclosure compete with the reference antibody for binding to human TIGIT and thereby reduce the amount of human TIGIT bound to the reference antibody as determined by an in vitro competitive binding assay. In various aspects, the antigen-binding proteins of the present disclosure inhibit the binding interaction between human TIGIT and the reference antibody and the inhibition is characterized by an $IC_{50}$. In various aspects, the antigen-binding proteins exhibit an $IC_{50}$ of less than about 250 nM for inhibiting the binding interaction between human TIGIT and the reference antibody. In various aspects, the antigen-binding proteins exhibit an $IC_{50}$ of less than about 200 nM, less than about 150 nM, less than about 100 nM, less than about 90 nm, less than about 80 nm, less than about 70 nm, less than about 60 nm, less than about 50 nm, less than about 40 nm, less than about 30 nm, less than about 20 nm, or less than about 10 nm. In various aspects, the antigen-binding proteins exhibit an $IC_{50}$ of less than about 9 nM, less than about 8 nM, less than about 7 nM, less than about 6 nM, less than about 5 nM, less than about 4 nM, less than about 3 nM, less than about 2 nM, less than about 1 nM, less than 0.5 nM or less than 0.1 nM. In various instances, the antigen-binding proteins of the present disclosure compete with the reference antibody for binding to human TIGIT and thereby reduce the amount of human TIGIT bound to the reference antibody as determined by a FACS-based assay in which the fluorescence of a fluorophore-conjugated secondary antibody which binds to the Fc of the reference antibody is measured in the absence or presence of a particular amount of the antigen-binding protein of the present disclosure. In various aspects, the FACS-based assay is carried out with the reference antibody, fluorophore-conjugated secondary antibody and cells which express TIGIT. In various aspects, the cells are genetically-engineered to overexpress TIGIT. In some aspects, the cells are HEK293T cells transduced with a viral vector to express TIGIT. In alternative aspects, the cells endogenously express TIGIT. Before the FACS-based assay is carried out, in some aspects, the cells which endogenously express TIGIT are pre-determined as low TIGIT-expressing cells or high TIGIT-expressing cells.

In exemplary aspects, the antigen-binding protein, e.g., antibody, inhibits a binding interaction between human TIGIT and its native ligand, e.g., CD155, CD112. In various instances, the antigen-binding protein, e.g., antibody, inhibits a binding interaction between human TIGIT and CD155 as determined by a FACS-based receptor-ligand competition binding assay, such as that described herein at Example 5. In various aspects, greater than 80% (e.g., greater than 85%, greater than 90%) of the binding interactions between human TIGIT and CD155 are inhibited in the presence of the presently disclosed antigen binding protein, e.g., antibody. Optionally, greater than 95% (e.g., greater than 96%, greater than 97%, greater than 98%, greater than 99% or nearly 100%) of the binding interactions between human TIGIT and CD155 are inhibited in the presence of the presently disclosed antigen binding protein, e.g., antibody, as determined by a FACS-based receptor-ligand competition binding assay, such as that described herein at Example 5.

In various embodiments, the antigen-binding protein, e.g., antibody, inhibits a binding interaction between human CD112R and a reference antibody, which reference antibody is known to bind to CD112R but is not an antigen-binding protein of the present disclosure. In various instances, the CD112R-binding proteins of the present disclosure compete with the reference antibody for binding to human CD112R and thereby reduce the amount of human CD112R bound to the reference antibody as determined by an in vitro competitive binding assay. In various aspects, the antigen-binding proteins of the present disclosure inhibit the binding interaction between human CD112R and the reference antibody and the inhibition is characterized by an $IC_{50}$. In various aspects, the antigen-binding proteins exhibit an $IC_{50}$ of less than 250 nM for inhibiting the binding interaction between human CD112R and the reference antibody. In various aspects, the antigen-binding proteins exhibit an $IC_{50}$ of less than about 200 nM, less than about 150 nM, less than about 100 nM, less than about 90 nm, less than about 80 nm, less than about 70 nm, less than about 60 nm, less than about 50 nm, less than about 40 nm, less than about 30 nm, less than about 20 nm, or less than about 10 nm. In various aspects, the antigen-binding proteins exhibit an $IC_{50}$ of less than about 9 nM, less than about 8 nM, less than about 7 nM, less than about 6 nM, less than about 5 nM, less than about 4 nM, less than about 3 nM, less than about 2 nM, less than about 1 nM, less than 0.5 nM or less than 0.1 nM. Optionally, the antigen-binding proteins exhibit an $IC_{50}$ of about 0.05 nM to about 0.5 nM (e.g., about 0.06 nM, about 0.07 nM, about 0.08 nM, about 0.09 nM, about 0.1 nM, about 0.2 nM, about 0.3 nM, about 0.4 nM, about 0.5 nM). In various instances, the antigen-binding proteins of the present disclosure compete with the reference antibody for binding to human CD112R and thereby reduce the amount of human CD112R bound to the reference antibody as determined by a FACS-based assay in which the fluorescence of a fluorophore-conjugated secondary antibody which binds to the Fc of the reference antibody is measured in the absence or presence of a particular amount of the antigen-binding protein of the present disclosure. In various aspects, the FACS-based assay is carried out with the reference antibody, fluorophore-conjugated secondary antibody and cells which express CD112R. In various aspects, the cells are genetically-engineered to overexpress CD112R. In some aspects, the cells are HEK293T cells transduced with a viral vector to express CD112R. In alternative aspects, the cells endogenously express CD112R. Before the FACS-based assay is carried out, in some aspects, the cells which endogenously express CD112R are pre-determined as low CD112R-expressing cells or high CD112R-expressing cells.

In exemplary aspects, the antigen-binding protein, e.g., antibody, inhibits a binding interaction between human CD112R and its native ligand, e.g., CD112. In various instances, the antigen-binding protein, e.g., antibody, inhibits a binding interaction between human CD112R and CD112 as determined by a FACS-based receptor-ligand competition binding assay, such as that described herein at Example 3. In various aspects, greater than 90% of the binding interactions between human CD112R and CD112 are inhibited in the presence of the presently disclosed antigen binding protein, e.g., antibody. Optionally, greater than 95% (e.g., greater than 96%, greater than 97%, greater than 98%, greater than 99% or nearly 100%) of the binding interactions between human CD112R and CD112 are inhibited in the presence of the presently disclosed antigen binding protein, e.g., antibody, as determined by a FACS-based receptor-ligand competition binding assay, such as that described herein at Example 3.

Other binding assays, e.g., competitive binding assays or competition assays, which test the ability of an antibody to compete with another antigen-binding protein for binding to an antigen, or to an epitope thereof, are known in the art. See, e.g., Trikha et al., Int J Cancer 110: 326-335 (2004); Tam et al., Circulation 98(11): 1085-1091 (1998); U.S. Patent Application Publication No. US20140178905, Chand et al., Biologicals 46: 168-171 (2017); Liu et al., Anal Biochem 525: 89-91 (2017); Goolia et al., J Vet Diagn Invest 29(2): 250-253 (2017); Hunter and Cochran, Methods Enzymol 250: 21-44 (2016); Cox et al., Immunoassay Methods, Immunoassay Methods. 2012 May 1 [Updated 2019 Jul. 8]. In: Sittampalam GS, Grossman A, Brimacombe K, et al., editors. Assay Guidance Manual [Internet]. Bethesda (MD): Eli Lilly & Company and the National Center for Advancing Translational Sciences; 2004; Clarke, William, "Immunoassays for Therapeutic Drug Monitoring and Clinical Toxicology", *Handbook of Analytical Separations*, Volume 5, pages 95-112 (2004), and Goolia et al., J Vet Diagn Invest 29(2): 250-253 (2017). Also, other methods of comparing two antibodies are known in the art, and include, for example, surface plasmon resonance (SPR). SPR can be used to determine the binding constants of the antibody and second antibody and the two binding constants can be compared.

Inhibition and Antagonism

In various instances, the antigen binding protein, e.g., antibody, binds to its target or antigen and inhibits the binding interaction between the target or antigen and its native ligand or binding partner. In exemplary aspects, the presently disclosed TIGIT binding protein binds to TIGIT and thereby inhibits the binding interaction between TIGIT and CD155. Alternatively or additionally, in exemplary instances, the presently disclosed TIGIT binding protein inhibits the binding interaction between TIGIT and other ligands (e.g., CD112). In exemplary aspects, the presently disclosed CD112R binding protein binds to CD112R and thereby inhibits the binding interaction between CD112R and CD112. Alternatively or additionally, in exemplary instances, the presently disclosed CD112R binding protein inhibits the binding interaction between CD112R and other ligands (e.g., CD96, CD226, TIGIT). In various aspects, the antigen binding protein, e.g., antibody, is an antagonist which inhibits the biological activity of the target or antigen. In various aspects, the CD112R binding protein binds to CD112R and inhibits the signal transduction pathway(s) activated upon CD112 binding to CD112R. In various aspects, the TIGIT binding protein binds to TIGIT and inhibits the signal transduction pathway(s) activated upon CD155 binding to TIGIT. Additional signal transduction pathway(s) may be inhibited upon binding of the TIGIT binding protein to TIGIT of upon binding of the CD112R binding protein to CD112R.

The reduction or inhibition provided by the antigen binding protein, e.g., antibody, may not be a 100% or complete inhibition or abrogation or reduction. Rather, there are varying degrees of reduction or inhibition of which one of ordinary skill in the art recognizes as having a potential benefit or therapeutic effect. In this regard, the antigen binding protein may inhibit the TIGIT and/or CD112R protein(s) to any amount or level. In exemplary embodiments, the reduction or inhibition provided by the antigen binding protein is at least or about 10% reduction or inhibition (e.g., at least or about 20% reduction or inhibition, at least or about 30% reduction or inhibition, at least or about 40% reduction or inhibition, at least or about 50% reduction or inhibition, at least or about 60% reduction or inhibition, at least or about 70% reduction or inhibition, at least or about 80% reduction or inhibition, at least or about 90% reduction or inhibition, at least or about 95% reduction or inhibition, at least or about 98% reduction or inhibition).

In exemplary instances, the antigen binding protein of the present disclosure inhibits binding CD112 to CD112R or TIGIT to CD155. In exemplary aspects, the inhibition may be characterized in terms of a half maximal inhibitory concentration (IC50) which is a measure of the effectiveness of the antigen binding protein in inhibiting a specific biological or biochemical function.

Suitable methods for measuring the inhibitory or antagonist activity of the antigen binding proteins of the present disclosure are known in the art. In exemplary instances, the antagonist or inhibitory activity of the antigen binding proteins may be assayed by measuring the level of TCR activation, given that simultaneous binding of CD112R to CD112 and/or TIGIT to CD155 and activation of the T-cell receptor (TCR) of a T-cell produces an inhibitory signal which inactivates or shuts off TCR-mediated responses, and, therefore, blocking the interaction between CD112R to CD112 and/or TIGIT to CD155 upon TCR ligation lead to TCR-mediated activities including one or more of phosphorylation of the TCR subunits, recruitment of Zap70 to the TCR, phosphorylation of LAT and/or SLP-76, calcium mobilization or calcium release from the endoplasmic reticulum (ER), activation of PLC-gamma, production of diacylglycerol (DAG) and inositol triphosphate (IP3), activation of Protein Kinase C, MARPK/Erk signaling, NF-κB activation, NFAT activation, activation of the IL-2 promoter, IL-2 production, IFN-gamma production, T cell proliferation and the like. See, e.g., Smith-Garvin et al., Annu Rev Immunol 27: 591-619 (2009). Thus, in various instances, the inhibitory or antagonist activity of the antigen binding proteins of the present disclosure may be assayed by measuring for IL-2 production, IFN-gamma production and/or activation of NF-κB and/or NFAT, for instance. In various aspects, a luciferase reporter gene assay is used with Jurkat T cells, wherein, upon TCR activation and in the presence of TIGIT binding proteins and/or CD112R binding proteins, luciferase activity is measured. In the presence of the TIGIT binding proteins and/or CD112R binding proteins, luciferase activity is expected to be higher than the luciferase activity observed in the absence of the TIGIT binding proteins and/or CD112R binding proteins. Jurkat RGA are described herein in the Examples (See, e.g., Example 3 and Example 5). In various aspects, the antagonist activity of the TIGIT binding proteins and/or CD112R binding proteins may be measured by a receptor-ligand binding assay or a Jurkat RGA. In various aspects, the antagonist activity or inhibitory activity of the antigen binding proteins of the present disclosure may be measured by an Jurkat RGA and the activity is expressed as an $EC_{50}$. In various instances, the $EC_{50}$ of the CD112R antigen binding protein or the TIGIT antigen binding protein is within about 0.01 nM to about 10 nM, about 0.01 nM to about 9 nM, about 0.01 nM to about 8 nM, about 0.01 nM to about 7 nM, about 0.01 nM to about 6 nM, about 0.01 nM to about 5 nM, about 0.01 nM to about 4 nM, about 0.01 nM to about 3 nM, about 0.01 nM to about 2 nM, about 0.01 nM to about 1 nM, about 0.01 nM to about 0.5 nM, about 0.01 nM to about 0.1 nM, about 0.01 nM to about 0.05 nM, about 0.05 nM to about 10 nM, about 0.1 nM to about 10 nM, about 0.5 nM to about 10 nM, about 1 nM to about 10 nM, about 2 nM to about 10 nM, about 3 nM to about 10 nM, about 4 nM to about 10 nM, about 5 nM to about 10 nM, about 6 nM to about 10 nM, about 7 nM to about 10 nM, about 8 nM to about 10 nM, or about 9 nM to about 10 nM. Optionally, the CD112R antigen binding protein exhibits an $EC_{50}$ in a Jurkat RGA as described above and/or as described in FIG. 7B or in Tables 2-5. Optionally, the TIGIT antigen binding protein exhibits an $EC_{50}$ in a Jurkat RGA as described above and/or as described in Tables 13-15.

The $IC_{50}$ of the CD112R antigen binding protein is, in exemplary aspects, less than about 10 nM, optionally, less than 5 nM. In exemplary aspects, the $IC_{50}$ of the CD112R antigen binding protein is less than 2 nM or less than 1 nM. In exemplary aspects, the $IC_{50}$ of the CD112R antigen binding protein is about 0.5 nM to about 2 nM. In various instances, the $IC_{50}$ of the CD112R antigen binding protein is within about 0.01 nM to about 10 nM, about 0.01 nM to about 9 nM, about 0.01 nM to about 8 nM, about 0.01 nM to about 7 nM, about 0.01 nM to about 6 nM, about 0.01 nM to about 5 nM, about 0.01 nM to about 4 nM, about 0.01 nM to about 3 nM, about 0.01 nM to about 2 nM, about 0.01 nM to about 1 nM, about 0.01 nM to about 0.5 nM, about 0.01 nM to about 0.1 nM, about 0.01 nM to about 0.05 nM, about 0.05 nM to about 10 nM, about 0.1 nM to about 10 nM, about 0.5 nM to about 10 nM, about 1 nM to about 10 nM, about 2 nM to about 10 nM, about 3 nM to about 10 nM, about 4 nM to about 10 nM, about 5 nM to about 10 nM, about 6 nM to about 10 nM, about 7 nM to about 10 nM, about 8 nM to about 10 nM, or about 9 nM to about 10 nM. In various aspects, the $IC_{50}$ of the CD112R antigen binding protein is a measure of the effectiveness of the CD112R antigen binding protein in inhibiting the binding interaction between CD112R and CD112 as determined by a receptor-ligand binding assay. See, e.g., Example 3.

The $IC_{50}$ of the TIGIT antigen binding protein is, in exemplary aspects, less than about 10 nM, optionally, less than 5 nM. In exemplary aspects, the $IC_{50}$ of the TIGIT antigen binding protein is less than 2 nM or less than 1 nM. In exemplary aspects, the $IC_{50}$ of the TIGIT antigen binding protein is about 0.5 nM to about 2 nM. In various instances, the $IC_{50}$ of the TIGIT antigen binding protein is within about 0.01 nM to about 10 nM, about 0.01 nM to about 9 nM, about 0.01 nM to about 8 nM, about 0.01 nM to about 7 nM, about 0.01 nM to about 6 nM, about 0.01 nM to about 5 nM, about 0.01 nM to about 4 nM, about 0.01 nM to about 3 nM, about 0.01 nM to about 2 nM, about 0.01 nM to about 1 nM, about 0.01 nM to about 0.5 nM, about 0.01 nM to about 0.1 nM, about 0.01 nM to about 0.05 nM, about 0.05 nM to about 10 nM, about 0.1 nM to about 10 nM, about 0.5 nM to about 10 nM, about 1 nM to about 10 nM, about 2 nM to about 10 nM, about 3 nM to about 10 nM, about 4 nM to about 10 nM, about 5 nM to about 10 nM, about 6 nM to about 10 nM, about 7 nM to about 10 nM, about 8 nM to about 10 nM, or about 9 nM to about 10 nM. In various aspects, the $IC_{50}$ of the TIGIT antigen binding protein is a measure of the effectiveness of the TIGIT antigen binding protein in inhibiting the binding interaction between TIGIT and CD155 or CD112 as determined by a receptor-ligand binding assay. See, e.g., Example 5.

Antigen Binding Protein Types

The antigen-binding proteins of the present disclosure can take any one of many forms of antigen-binding proteins known in the art. In exemplary aspects, the antigen-binding protein is an antibody or immunoglobulin, or an antigen binding antibody fragment thereof, or an antibody protein product.

Collectively, antibodies form a family of plasma proteins known as immunoglobulins and comprise of immunoglobulin domains. (Janeway et al., Immunobiology: The Immune System in Health and Disease, 4$^{th}$ ed., Elsevier Science Ltd./Garland Publishing, 1999. As used herein, the term "antibody" refers to a protein having a conventional immunoglobulin format, comprising heavy and light chains, and comprising variable and constant regions. For example, an antibody may be an IgG which is a "Y-shaped" structure of two identical pairs of polypeptide chains, each pair having one "light" (typically having a molecular weight of about 25 kDa) and one "heavy" chain (typically having a molecular weight of about 50-70 kDa). An antibody has a variable region and a constant region. In IgG formats, the variable region is generally about 100-110 or more amino acids, comprises three complementarity determining regions (CDRs), is primarily responsible for antigen recognition, and substantially varies among other antibodies that bind to different antigens. The constant region allows the antibody to recruit cells and molecules of the immune system. The variable region is made of the N-terminal regions of each light chain and heavy chain, while the constant region is made of the C-terminal portions of each of the heavy and light chains. (Janeway et al., "Structure of the Antibody Molecule and the Immunoglobulin Genes", Immunobiology: The Immune System in Health and Disease, 4$^{th}$ ed. Elsevier Science Ltd./Garland Publishing, (1999)).

The general structure and properties of CDRs of antibodies have been described in the art. Briefly, in an antibody scaffold, the CDRs are embedded within a framework in the heavy and light chain variable region where they constitute the regions largely responsible for antigen binding and recognition. A variable region typically comprises at least three heavy or light chain CDRs (Kabat et al., 1991, Sequences of Proteins of Immunological Interest, Public Health Service N.I.H., Bethesda, Md.; see also Chothia and Lesk, 1987, J. Mol. Biol. 196:901-917; Chothia et al., 1989, Nature 342: 877-883), within a framework region (designated framework regions 1-4, FR1, FR2, FR3, and FR4, by Kabat et al., 1991; see also Chothia and Lesk, 1987, supra).

Antibodies can comprise any constant region known in the art. Human light chains are classified as kappa and lambda light chains. Heavy chains are classified as mu, delta, gamma, alpha, or epsilon, and define the antibody's isotype as IgM, IgD, IgG, IgA, and IgE, respectively. IgG has several subclasses, including, but not limited to IgG1, IgG2, IgG3, and IgG4. IgM has subclasses, including, but not limited to, IgM1 and IgM2. Embodiments of the present disclosure include all such classes or isotypes of antibodies. The light chain constant region can be, for example, a kappa- or lambda-type light chain constant region, e.g., a human kappa- or lambda-type light chain constant region. The heavy chain constant region can be, for example, an alpha-, delta-, epsilon-, gamma-, or mu-type heavy chain constant regions, e.g., a human alpha-, delta-, epsilon-, gamma-, or mu-type heavy chain constant region. Accordingly, in exemplary embodiments, the antibody is an antibody of isotype IgA, IgD, IgE, IgG, or IgM, including any one of IgG1, IgG2, IgG3 or IgG4.

The antibody can be a monoclonal antibody or a polyclonal antibody. In some embodiments, the antibody comprises a sequence that is substantially similar to a naturally-occurring antibody produced by a mammal, e.g., mouse, rabbit, goat, horse, chicken, hamster, human, and the like. In this regard, the antibody can be considered as a mammalian antibody, e.g., a mouse antibody, rabbit antibody, goat antibody, horse antibody, chicken antibody, hamster antibody, human antibody, and the like. In certain aspects, the antibody is a human antibody. In certain aspects, the antibody is a chimeric antibody or a humanized antibody. The term "chimeric antibody" refers to an antibody containing domains from two or more different antibodies. A chimeric antibody can, for example, contain the constant domains from one species and the variable domains from a second, or more generally, can contain stretches of amino acid sequence from at least two species. A chimeric antibody also can contain domains of two or more different antibodies within the same species. The term "humanized" when used in relation to antibodies refers to antibodies having at least CDR regions from a non-human source which are engineered to have a structure and immunological function more similar to true human antibodies than the original source antibodies. For example, humanizing can involve grafting a CDR from a non-human antibody, such as a mouse antibody, into a human antibody. Humanizing also can involve select amino acid substitutions to make a non-human sequence more similar to a human sequence.

An antibody can be cleaved into fragments by enzymes, such as, e.g., papain and pepsin. Papain cleaves an antibody to produce two Fab fragments and a single Fc fragment. Pepsin cleaves an antibody to produce a F(ab')$_2$ fragment and a pFc' fragment. In exemplary aspects of the present disclosure, the antigen binding protein of the present disclosure comprises an antigen binding antibody fragment. As used herein, the term "antigen binding antibody fragment" refers to a portion of an antibody molecule that is capable of binding to the antigen of the antibody and is also known as "antigen-binding fragment" or "antigen-binding portion". In exemplary instances, the antigen binding antibody fragment is a Fab fragment or a F(ab')$_2$ fragment.

The architecture of antibodies has been exploited to create a growing range of alternative formats that span a molecular-weight range of at least about 12-150 kDa and has a valency (n) range from monomeric (n=1), to dimeric (n=2), to trimeric (n=3), to tetrameric (n=4), and potentially higher; such alternative formats are referred to herein as "antibody protein products". Antibody protein products include those based on the full antibody structure and those that mimic antibody fragments which retain full antigen-binding capacity, e.g., scFvs, Fabs and VHH/VH (discussed below). The smallest antigen binding antibody fragment that retains its complete antigen binding site is the Fv fragment, which consists entirely of variable (V) regions. A soluble, flexible amino acid peptide linker is used to connect the V regions to a scFv (single chain fragment variable) fragment for stabilization of the molecule, or the constant (C) domains are added to the V regions to generate a Fab fragment [fragment, antigen-binding]. Both scFv and Fab fragments can be easily produced in host cells, e.g., prokaryotic host cells. Other antibody protein products include disulfide-bond stabilized scFv (ds-scFv), single chain Fab (scFab), as well as di- and multimeric antibody formats like dia-, tria- and tetra-bodies, or minibodies (miniAbs) that comprise different formats consisting of scFvs linked to oligomerization domains. The smallest fragments are VHH/VH of camelid heavy chain Abs as well as single domain Abs (sdAb). The building block that is most frequently used to create novel antibody formats is the single-chain variable (V)-domain antibody fragment (scFv), which comprises V domains from the heavy and light chain (VH and VL domain) linked by a peptide linker of ~15 amino acid residues. A peptibody or peptide-Fc fusion is yet another antibody protein product. The structure of a peptibody consists of a biologically active peptide grafted onto an Fc domain. Peptibodies are well-described in the art. See, e.g., Shimamoto et al., mAbs 4(5): 586-591 (2012).

Other antibody protein products include a single chain antibody (SCA); a diabody; a triabody; a tetrabody; bispecific or trispecific antibodies, and the like. Bispecific antibodies can be divided into five major classes: BsIgG, appended IgG, BsAb fragments, bispecific fusion proteins and BsAb conjugates. See, e.g., Spiess et al., Molecular Immunology 67(2) Part A: 97-106 (2015).

In exemplary aspects, the antigen binding protein of the present disclosure comprises any one of these antibody protein products. In exemplary aspects, the antigen binding protein of the present disclosure comprises any one of an scFv, Fab VHH/VH, Fv fragment, ds-scFv, scFab, dimeric antibody, multimeric antibody (e.g., a diabody, triabody, tetrabody), miniAb, peptibody VHH/VH of camelid heavy chain antibody, sdAb, diabody; a triabody; a tetrabody; a bispecific or trispecific antibody, BsIgG, appended IgG, BsAb fragment, bispecific fusion protein, and BsAb conjugate.

In exemplary instances, the antigen binding protein of the present disclosure comprises an antibody protein product in monomeric form, or polymeric, oligomeric, or multimeric form. In certain embodiments in which the antibody comprises two or more distinct antigen binding regions fragments, the antibody is considered bispecific, trispecific, or multi-specific, or bivalent, trivalent, or multivalent, depending on the number of distinct epitopes that are recognized and bound by the antibody. In exemplary aspects, the antigen binding protein of the present disclosure is a bispecific antibody (bsAb) comprising two scFv, one which binds to TIGIT and one which binds to CD112R. In various aspects, the scFv which binds to CD112R comprises the light chain variable region and heavy chain variable region of 29E10, 24F1 or 11E4. In various aspects, the scFv which binds to TIGIT comprises the light chain variable region and heavy chain variable region of 43B7.002.015, 66H9.009, or 58A7.002.008. In exemplary instances, each scFv is linked to a heavy chain and/or light chain, optionally, an IgG heavy chain and/or an IgG light chain.

Structure of Antigen Binding Proteins

In exemplary aspects, the CD112R antigen binding protein (e.g., an antibody or antigen binding fragment thereof) comprises (a) a heavy chain (HC) complementarity-determining region (CDR) 1 amino acid sequence set forth in Table A1 or a variant sequence thereof which differs by only 1-4 amino acids (e.g., 1, 2, 3, 4 amino acids) or which has at least or about 90% sequence identity; (b) an HC CDR2 amino acid sequence set forth in Table A1 or a variant sequence thereof which differs by only 1-4 amino acids or which has at least or about 90% sequence identity; (c) an HC CDR3 amino acid sequence set forth in Table A1 or a variant sequence thereof which differs by only 1-4 amino acids or which has at least or about 90% sequence identity; (d) a light chain (LC) CDR1 amino acid sequence set forth in Table A1 or a variant sequence thereof which differs by only 1-4 amino acids or which has at least or about 90% sequence identity; (e) an LC CDR2 amino acid sequence set forth in Table A1 or a variant sequence thereof which differs by only 1-4 amino acids or which has at least or about 90% sequence identity; (f) an LC CDR3 amino acid sequence set forth in Table A1 or a variant sequence thereof which differs by only 1-4 amino acids or which has at least or about 90% sequence identity; or (g) a combination of any two, three, four, five, or six of (a)-(f).

TABLE A1

SEQ ID NOs: of CDRs of CD112R antigen binding proteins

| Name | Heavy Chain (HC) | | | Light Chain (LC) | | |
| --- | --- | --- | --- | --- | --- | --- |
| | CDR1 | CDR2 | CDR3 | CDR1 | CDR2 | CDR3 |
| 1E1 | 13 | 14 | 15 | 16 | 17 | 18 |
| 1E1.016 | 23 | 24 | 25 | 26 | 27 | 28 |
| 24F1 | 33 | 34 | 35 | 36 | 37 | 38 |
| 29E10 | 43 | 44 | 45 | 46 | 47 | 48 |
| 24F1.001 | 53 | 54 | 55 | 56 | 57 | 58 |
| 29E10_CONS.020 | 63 | 64 | 65 | 66 | 67 | 68 |
| 29E10_CONS.021 | 73 | 74 | 75 | 76 | 77 | 78 |
| 29E10_CONS.022 | 83 | 84 | 85 | 86 | 87 | 88 |
| 29E10_CONS.025 | 93 | 94 | 95 | 96 | 97 | 98 |
| 11E4 | 103 | 104 | 105 | 106 | 107 | 108 |
| 31B3 | 233 | 234 | 235 | 236 | 237 | 238 |
| 27G12 | 1973 | 1974 | 1975 | 1976 | 1977 | 1978 |
| 28F9 | 1983 | 1984 | 1985 | 1986 | 1987 | 1988 |
| 28H7 | 1993 | 1994 | 1995 | 1996 | 1997 | 1998 |
| 36C8 | 2003 | 2004 | 2005 | 2006 | 2007 | 2008 |

1E1 also known as 18C10.

In exemplary aspects, the CD112R antigen binding protein (e.g., an antibody or antigen binding fragment thereof) comprises a LC CDR1 amino acid sequence, a LC CDR2 amino acid sequence, and a LC CDR3 amino acid sequence set forth in Table A1 and at least 1 or 2 of the HC CDR amino acid sequences set forth in Table A1. In exemplary aspects, the CD112R antigen binding protein comprises a HC CDR1 amino acid sequence, a HC CDR2 amino acid sequence, and a HC CDR3 amino acid sequence set forth in Table A1 and at least 1 or 2 of the LC CDR amino acid sequences set forth in Table A1. In some embodiments, the CD112R antigen binding protein comprises all three such CDRs. In exemplary embodiments, the CD112R antigen binding protein comprises 3, 4, 5, or all 6 of the amino acid sequences designated by the SEQ ID NOs: in a single row of Table A1. In exemplary embodiments, the CD112R antigen binding protein comprises each of the LC CDR amino acid sequences designated by the SEQ ID NOs: of a single row of Table A1 and at least 1 or 2 of the HC CDR amino acid sequences designated by the SEQ ID NOs: in the same single row or another single row of Table A1. In exemplary embodiments, the CD112R antigen binding protein comprises each of the HC CDR amino acid sequences designated by the SEQ ID NOs: of a single row of Table A1 and at least 1 or 2 of the LC CDR amino acid sequences designated by the SEQ ID NOs: in the same single row or another single row of Table A1. In exemplary embodiments, the CD112R antigen binding protein comprises six CDR amino acid sequences listed in a single row of Table A1 or comprising six CDR amino acid sequences selected from the group consisting of: (a) SEQ ID NOs: 13-18; (b) SEQ ID NOs: 23-28; (c) SEQ ID NOs: 33-38; (d) SEQ ID NOs: 43-48; (e) SEQ ID NOs: 53-58; (f) SEQ ID NOs: 63-68; (g) SEQ ID NOs: 73-78; (h) SEQ ID NOs: 83-88, (i) SEQ ID NOs: 93-98, (j) SEQ ID NOs: 103-108, (k) SEQ ID NOs: 233-238, (l) SEQ ID NOs: 1973-1978, (m) SEQ ID NOs: 1983-1988, (n) SEQ ID NOs: 1993-1998, and (o) SEQ ID NOs: 2003-2008. In exemplary aspects, the CD112R antigen binding protein comprises the six CDR amino acid sequences as described above and a heavy chain constant region comprising the amino acid sequence of SEQ ID NO: 2019 or SEQ ID NO: 2020

In exemplary instances, the amino acid sequences of Table A1 are separated by at least one or more (e.g., at least 2, 3, 4, 5, 6, 7, 8, 9, 10, or more) intervening amino acid(s), e.g., framework residues. In exemplary instances, there are about 10 to about 20 amino acids between the sequences of the LC CDR1 and the LC CDR2 and about 25 to about 40 amino acids between the sequences of the LC CDR2 and the LC CDR3. In exemplary instances, there are about 14 to about 16 amino acids between the sequences of the LC CDR1 and the LC CDR2 and about 30 to about 35 amino acids between the sequences of LC CDR2 and the LC CDR3. In exemplary instances, there are about 10 to about 20 amino acids between the sequences of the HC CDR1 and HC CDR2 and about 25 to about 40 amino acids between the sequences of the HC CDR2 and the HC CDR3. In exemplary instances, there are about 14 to about 16 amino acids between the sequences of the HC CDR1 and HC CDR2 and about 30 to about 35 amino acids between the sequences of the HC CDR2 and HC CDR3. In exemplary aspects, the intervening amino acids comprise a framework region.

In exemplary aspects, the TIGIT antigen binding protein (e.g., an antibody or antigen binding fragment thereof) comprises (a) a heavy chain (HC) complementarity-determining region (CDR) 1 amino acid sequence set forth in Table A2 or a variant sequence thereof which differs by only 1-4 amino acids (e.g., 1, 2, 3, 4 amino acids) or which has at least or about 90% sequence identity; (b) an HC CDR2 amino acid sequence set forth in Table A2 or a variant sequence thereof which differs by only 1-4 amino acids or which has at least or about 90% sequence identity; (c) an HC CDR3 amino acid sequence set forth in Table A2 or a variant sequence thereof which differs by only 1-4 amino acids or which has at least or about 90% sequence identity; (d) a light chain (LC) CDR1 amino acid sequence set forth in Table A2 or a variant sequence thereof which differs by only 1-4 amino acids or which has at least or about 90% sequence identity; (e) an LC CDR2 amino acid sequence set forth in Table A2 or a variant sequence thereof which differs by only 1-4 amino acids or which has at least or about 90% sequence identity; (f) an LC CDR3 amino acid sequence set forth in Table A2 or a variant sequence thereof which differs by only 1-4 amino acids or which has at least or about 90% sequence identity; or (g) a combination of any two, three, four, five, or six of (a)-(f).

TABLE A2

SEQ ID NOS: of CDRs of TIGIT antigen binding proteins

| Name | Heavy Chain (HC) | | | Light Chain (LC) | | |
| --- | --- | --- | --- | --- | --- | --- |
| | CDR1 | CDR2 | CDR3 | CDR1 | CDR2 | CDR3 |
| 55G7.041.008 | 113 | 114 | 115 | 116 | 117 | 118 |
| 58A7.003.008.075 | 123 | 124 | 125 | 126 | 127 | 128 |
| 4G10 | 133 | 134 | 135 | 136 | 137 | 138 |
| 11A3 | 143 | 144 | 145 | 146 | 147 | 148 |
| 28B8 | 153 | 154 | 155 | 156 | 157 | 158 |
| 39D2 | 163 | 164 | 165 | 166 | 167 | 168 |
| 43B7 | 173 | 174 | 175 | 176 | 177 | 178 |
| 55G7 | 183 | 184 | 185 | 186 | 187 | 188 |
| 66H9 | 193 | 194 | 195 | 196 | 197 | 198 |
| 43B7.002.015 | 203 | 204 | 205 | 206 | 207 | 208 |
| 58A7.003.008 | 213 | 214 | 215 | 216 | 217 | 218 |
| 66H9.009 | 223 | 224 | 225 | 226 | 227 | 228 |
| 58A7 | 2013 | 2014 | 2015 | 2016 | 2017 | 2018 |

*58A7 also known as 48B7

In exemplary aspects, the TIGIT antigen binding protein (e.g., an antibody or antigen binding fragment thereof) comprises a LC CDR1 amino acid sequence, a LC CDR2 amino acid sequence, and a LC CDR3 amino acid sequence set forth in Table A2 and at least 1 or 2 of the HC CDR amino acid sequences set forth in Table A2. In exemplary aspects, the TIGIT antigen binding protein comprises a HC CDR1 amino acid sequence, a HC CDR2 amino acid sequence, and a HC CDR3 amino acid sequence set forth in Table A2 and at least 1 or 2 of the LC CDR amino acid sequences set forth in Table A2. In some embodiments, the TIGIT antigen binding protein comprises all three such CDRs. In exemplary embodiments, the TIGIT antigen binding protein comprises 3, 4, 5, or all 6 of the amino acid sequences designated by the SEQ ID NOs: in a single row of Table A2. In exemplary embodiments, the TIGIT antigen binding protein comprises each of the LC CDR amino acid sequences designated by the SEQ ID NOs: of a single row of Table A2 and at least 1 or 2 of the HC CDR amino acid sequences designated by the SEQ ID NOs: in the same single row or another single row of Table A2. In exemplary embodiments, the TIGIT antigen binding protein comprises each of the HC CDR amino acid sequences designated by the SEQ ID NOs: of a single row of Table A2 and at least 1 or 2 of the LC CDR amino acid sequences designated by the SEQ ID NOs: in the same single row or another single row of Table A2. In exemplary embodiments, the TIGIT antigen binding protein comprises six CDR amino acid sequences listed in a single row of Table A2 or comprising six CDR amino acid sequences selected from the group consisting of: (a) SEQ ID NOs: 113-118; (b) SEQ ID NOs: 123-128; (c) SEQ ID NOs: 133-138; (d) SEQ ID NOs: 143-148; (e) SEQ ID NOs: 153-158; (f) SEQ ID NOs: 163-168; (g) SEQ ID NOs: 173-178; (h) SEQ ID NOs: 183-188, (i) SEQ ID NOs: 193-198, (j) SEQ ID NOs: 203-208, (k) SEQ ID NOs: 213-218, (l) SEQ ID NOs:

223-228, and (m) SEQ ID NOs: 2013-2018. In exemplary aspects, the TIGIT antigen binding protein comprises the six CDR amino acid sequences as described above and a heavy chain constant region comprising the amino acid sequence of SEQ ID NO: 2019 or SEQ ID NO: 2020.

In exemplary instances, the amino acid sequences of Table A2 are separated by at least one or more (e.g., at least 2, 3, 4, 5, 6, 7, 8, 9, 10, or more) intervening amino acid(s), e.g., framework residues. In exemplary instances, there are about 10 to about 20 amino acids between the sequences of the LC CDR1 and the LC CDR2 and about 25 to about 40 amino acids between the sequences of the LC CDR2 and the LC CDR3. In exemplary instances, there are about 14 to about 16 amino acids between the sequences of the LC CDR1 and the LC CDR2 and about 30 to about 35 amino acids between the sequences of LC CDR2 and the LC CDR3. In exemplary instances, there are about 10 to about 20 amino acids between the sequences of the HC CDR1 and HC CDR2 and about 25 to about 40 amino acids between the sequences of the HC CDR2 and the HC CDR3. In exemplary instances, there are about 14 to about 16 amino acids between the sequences of the HC CDR1 and HC CDR2 and about 30 to about 35 amino acids between the sequences of the HC CDR2 and HC CDR3. In exemplary aspects, the intervening amino acids comprise a framework region.

In exemplary embodiments, the CD112R antigen binding protein (e.g., an antibody or antigen binding fragment thereof) comprises a pair of HC variable region and LC variable region amino acid sequences listed in a single row of Table B1 or comprising one of the following pairs of amino acid sequences: (a) SEQ ID NOs: 11-12; (b) SEQ ID NOs: 21-22; (c) SEQ ID NOs: 31-32; (d) SEQ ID NOs: 41-42; (e) SEQ ID NOs: 51-52; (f) SEQ ID NOs: 61-62; (g) SEQ ID NOs: 71-72; (h) SEQ ID NOs: 81-82, (i) SEQ ID NOs: 91-92, (j) SEQ ID NOs: 101-102, (k) SEQ ID NOs: 231-232, (l) SEQ ID NOs: 1971-1972, (m) SEQ ID NOs: 1981-1982, (n) SEQ ID NOs: 1991-1992, or (o) SEQ ID NOs: 2001-2002. In exemplary aspects, the CD112R antigen binding protein comprises the pair of HC variable region and LC variable region amino acid sequences as described above and a heavy chain constant region comprising the amino acid sequence of SEQ ID NO: 2019 or SEQ ID NO: 2020. In exemplary embodiments, the CD112R antigen binding protein comprises a pair of full-length (FL) HC and FL LC amino acid sequences listed in a single row of Table B1 or comprising one of the following pairs of amino acid sequences: (a) SEQ ID NOs: 9-10; (b) SEQ ID NOs: 19-20; (c) SEQ ID NOs: 29-30; (d) SEQ ID NOs: 39-40; (e) SEQ ID NOs: 49-50; (f) SEQ ID NOs: 59-60; (g) SEQ ID NOs: 69-70; (h) SEQ ID NOs: 79-80, (i) SEQ ID NOs: 89-90, (j) SEQ ID NOs: 99-100, (k) SEQ ID NOs: 229-230, (l) SEQ ID NOs: 1969-1970, (m) SEQ ID NOs: 1979-1980, (n) SEQ ID NOs: 1989-1990, or (o) SEQ ID NOs: 1999-2000.

TABLE B1

SEQ ID NOs: of Variable Regions and Full-Length (FL) Sequences of CD112R antigen binding proteins

| Name | FL HC | FL LC | HC variable region | LC variable region |
| --- | --- | --- | --- | --- |
| 1E1 | 9 | 10 | 11 | 12 |
| 1E1.016 | 19 | 20 | 21 | 22 |
| 24F1 | 29 | 30 | 31 | 32 |
| 29E10 | 39 | 40 | 41 | 42 |
| 24F1.001 | 49 | 50 | 51 | 52 |
| 29E10_CONS.020 | 59 | 60 | 61 | 62 |
| 29E10_CONS.021 | 69 | 70 | 71 | 72 |
| 29E10_CONS.022 | 79 | 80 | 81 | 82 |
| 29E10_CONS.025 | 89 | 90 | 91 | 92 |
| 11E4 | 99 | 100 | 101 | 102 |
| 31B3 | 229 | 230 | 231 | 232 |
| 27G12 | 1969 | 1970 | 1971 | 1972 |
| 28F9 | 1979 | 1980 | 1981 | 1982 |
| 28H7 | 1989 | 1990 | 1991 | 1992 |
| 36C8 | 1999 | 2000 | 2001 | 2002 |

In exemplary embodiments, the TIGIT antigen binding protein (e.g., an antibody or antigen binding fragment thereof) comprises a pair of HC variable region and LC variable region amino acid sequences listed in a single row of Table B2 or comprising one of the following pairs of amino acid sequences: (a) SEQ ID NOs: 111-112, (b) SEQ ID NOs: 121-122, (c) SEQ ID NOs: 131-132, (d) SEQ ID NOs: 141-142, (e) SEQ ID NOs: 151-152, (f) SEQ ID NOs: 161-162, (g) SEQ ID NOs: 171-172, (h) SEQ ID NOs: 181-182, (i) SEQ ID NOs: 191-192, (j) SEQ ID NOs: 201-202, (k) SEQ ID NOs: 211-212, (l) SEQ ID NOs: 221-222, or (m) SEQ ID NOs: 2011-2012. In exemplary aspects, the TIGIT antigen binding protein comprises the pair of HC variable region and LC variable region amino acid sequences as described above and a heavy chain constant region comprising the amino acid sequence of SEQ ID NO: 2019 or SEQ ID NO: 2020. In exemplary embodiments, the TIGIT antigen binding protein comprises a pair of full-length (FL) HC and FL LC amino acid sequences listed in a single row of Table B2 or comprising one of the following pairs of amino acid sequences: (a) SEQ ID NOs: 109-110, (b) SEQ ID NOs: 119-120, (c) SEQ ID NOs: 129-130, (d) SEQ ID NOs: 139-140, (e) SEQ ID NOs: 149-150, (f) SEQ ID NOs: 159-160, (g) SEQ ID NOs: 169-170, (h) SEQ ID NOs: 179-180, (i) SEQ ID NOs: 189-190, (j) SEQ ID NOs: 199-200, (k) SEQ ID NOs: 209-210, (l) SEQ ID NOs: 219-220, or (m) SEQ ID NOs: 2009-2010.

TABLE B2

SEQ ID NOs: of Variable Regions and Full-Length (FL) Sequences of TIGIT antigen binding proteins

| Name | FL HC | FL LC | HC variable region | LC variable region |
| --- | --- | --- | --- | --- |
| 55G7.041.008 | 109 | 110 | 111 | 112 |
| 58A7.003.008.075 | 119 | 120 | 121 | 122 |
| 4G10 | 129 | 130 | 131 | 132 |
| 11A3 | 139 | 140 | 141 | 142 |
| 28B8 | 149 | 150 | 151 | 152 |
| 39D2 | 159 | 160 | 161 | 162 |
| 43B7 | 169 | 170 | 171 | 172 |
| 55G7 | 179 | 180 | 181 | 182 |
| 66H9 | 189 | 190 | 191 | 192 |
| 43B7.002.015 | 199 | 200 | 201 | 202 |
| 58A7.003.008 | 209 | 210 | 211 | 212 |
| 66H9.009 | 219 | 220 | 221 | 222 |
| 58A7 | 2009 | 2010 | 2011 | 2012 |

In exemplary aspects, the CD112R antigen binding protein or the TIGIT antigen binding protein comprises an amino acid sequence which is similar to an above-referenced amino acid sequence, yet the antigen-binding protein substantially retains its biological function, e.g., its ability to bind to its target or antigen, e.g., human TIGIT, human CD112R, or to decrease, block, inhibit, abrogate or interfere with signal transduction resulting from the interaction of TIGIT with its binding partner, CD155, or from the interaction of CD112R with its binding partner, CD112.

In exemplary aspects, the CD112R antigen binding protein (e.g., an antibody or antigen binding fragment thereof) comprises an amino acid sequence which differs by only 1, 2, 3, 4, 5, 6, or more amino acids, relative to a parent amino acid sequence having an amino acid sequence referenced in Table A1 or Table B1. In exemplary aspects, the TIGIT antigen binding protein comprises an amino acid sequence which differs by only 1, 2, 3, 4, 5, 6, or more amino acids, relative to a parent amino acid sequence having an amino acid sequence referenced in Table A2 or Table B2. In exemplary aspects, the antigen binding protein (e.g., the CD112R antigen binding protein or the TIGIT antigen binding protein) comprises a variant sequence of the parent sequence, which variant sequence differs by only one or two amino acids, relative to the parent sequence. In exemplary aspects, the antigen-binding protein comprises one or more amino acid substitutions that occur outside of the CDRs, e.g., the one or more amino acid substitutions occur within the framework region(s) of the heavy or light chain. In exemplary aspects, the antigen binding protein comprises one or more amino acid substitutions, yet the antigen-binding protein retains the amino acid sequences of the six CDRs. In exemplary aspects, the antigen binding protein comprises an amino acid sequence having only 1, 2, 3, 4, 5, 6, or more conservative amino acid substitutions, relative to the parent sequence(s). As used herein, the term "conservative amino acid substitution" refers to the substitution of one amino acid with another amino acid having similar properties, e.g., size, charge, hydrophobicity, hydrophilicity, and/or aromaticity, and includes exchanges within one of the following five groups:

I. Small aliphatic, nonpolar or slightly polar residues: Ala, Ser, Thr, Pro, Gly;
II. Polar, negatively charged residues and their amides and esters: Asp, Asn, Glu, Gln, cystic acid and homocysteic acid;
III. Polar, positively charged residues: His, Arg, Lys; Ornithine (Orn)
IV. Large, aliphatic, nonpolar residues: Met, Leu, Ile, Val, Cys, Norleucine (Nle), homocysteine
V. Large, aromatic residues: Phe, Tyr, Trp, acetyl phenylalanine.

In exemplary embodiments, the antigen binding protein (e.g., an antibody or antigen binding fragment thereof) comprises an amino acid sequence comprising at least one amino acid substitution relative to the parent sequence, and the amino acid substitution(s) is/are non-conservative amino acid substitution(s). As used herein, the term "non-conservative amino acid substitution" is defined herein as the substitution of one amino acid with another amino acid having different properties, e.g., size, charge, hydrophobicity, hydrophilicity, and/or aromaticity, and includes exchanges outside the above five groups.

In exemplary aspects, the antigen binding protein (e.g., an antibody or antigen binding fragment thereof) comprises an amino acid sequence comprising at least one amino acid substitution relative to the parent sequence, and the substitute amino acid is a naturally-occurring amino acid. By "naturally-occurring amino acid" or "standard amino acid" or "canonical amino acid" is meant one of the 20 alpha amino acids found in eukaryotes encoded directly by the codons of the universal genetic code (Ala, Val, Ile, Leu, Met, Phe, Tyr, Trp, Ser, Thr, Asn, Gln, Cys, Gly, Pro, Arg, His, Lys, Asp, Glu). In exemplary aspects, the antigen binding protein comprises an amino acid sequence comprising at least one amino acid substitution relative to the parent sequence, and the substitute amino acid is a non-standard amino acid, or an amino acid which is not incorporated into proteins during translation. Non-standard amino acids include, but are not limited to: selenocysteine, pyrrolysine, ornithine, norleucine, β-amino acids (e.g., β-alanine, β-aminoisobutyric acid, β-phenylalanine, β-homophenylalanine, β-glutamic acid, β-glutamine, β-homotryptophan, β-leucine, β-lysine), homo-amino acids (e.g., homophenylalanine, homoserine, homoarginine, monocysteine, homocystine), N-methyl amino acids (e.g., L-abrine, N-methyl-alanine, N-methyl-isoleucine, N-methyl-leucine), 2-aminocaprylic acid, 7-aminocephalosporanic acid, 4-aminocinnamic acid, alpha-aminocyclohexanepropionic acid, amino-(4-hydroxyphenyl)acetic acid, 4-amino-nicotinic acid, 3-aminophenylacetic acid, and the like.

In exemplary aspects, the antigen binding protein comprises an amino acid sequence which has greater than or about 30%, greater than or about 50%, or greater than or about 70% sequence identity to the parent amino acid sequence(s). In exemplary aspects, the antigen-binding protein comprises an amino acid sequence which has at least 30%, at least 40%, at least 50%, at least 60%, at least 70%, at least 80%, at least 85%, at least 90% or has greater than 90% sequence identity to the parent amino acid sequence. In exemplary aspects, the antigen-binding protein comprises an amino acid sequence that has at least 70%, at least 80%, at least 85%, at least 90% or has greater than 90% sequence identity along the full-length of the parent amino acid sequence. In exemplary aspects, the antigen-binding protein comprises an amino acid sequence having at least 95%, 96%, 97%, 98% or 99% sequence identity along the full-length of the parent amino acid sequence.

In various aspects, the CD112R antigen binding protein (e.g., an antibody or antigen binding fragment thereof) comprises a variant sequence of a HC variable region amino acid sequence or a variant sequence of a LC variable region amino acid sequence listed in Table B1 which variant sequence differs from the sequence of Table B1 by only 1 to 12 amino (e.g., 1 to 11, 1 to 10, 1 to 9, 1 to 8, 1 to 7, 1 to 6, 1 to 5, 1 to 4, 1 to 3, 1 or 2) acids or which has at least or about 70% sequence identity (e.g., at least or about 80% sequence identity, at least or about 90% sequence identity, at least or about 95% sequence identity). In various aspects, the CD112R antigen binding protein comprises a variant sequence of a FL HC amino acid sequence or a variant sequence of a FL LC amino acid sequence listed in Table B1 which variant sequence differs from the sequence of Table B1 by only 1 to 46 amino acids or which has at least or about 70% sequence identity (e.g., at least or about 80% sequence identity, at least or about 90% sequence identity, at least or about 95% sequence identity). In exemplary embodiments, the CD112R antigen binding protein comprises a pair of HC variable region and LC variable region amino acid sequences listed in a single row of Table C1 or comprising one of the following pairs of amino acid sequences: (a) the first 100 amino acids of each of SEQ ID NOs: 241 and 242; (b) the first 100 amino acids of each of SEQ ID NOs: 247 and 248; (c) the first 100 amino acids of each of SEQ ID NOs: 249 and 250; (d) the first 100 amino acids of each of SEQ ID NOs: 251 and 252; or (e) the first 100 amino acids of each of SEQ ID NOs: 263 and 264. In exemplary aspects, the CD112R antigen binding protein comprises the first 105, first 106, first 107, first 108, first 109, first 110, first 111, first 112, first 113, first 114, or first 115 amino acids of SEQ ID NO: 242, SEQ ID NO: 248, SEQ ID NIO: 250, SEQ ID NO: 252, or SEQ ID NO: 264, and/or the first 115, first 116, first 117, first 118, first 119, first 120, first 121, first 122, first 123, first 124, first 125, first 126, or first 127 amino acids of SEQ ID NO: 241, SEQ ID NO: 247, SEQ ID NIO: 249, SEQ ID NO: 251, or SEQ ID NO: 263. In exemplary embodiments, the CD112R antigen binding protein comprises a pair of full-length (FL) HC and FL LC amino acid sequences listed in a single row of Table C1 or comprising one of the following pairs of amino acid sequences: (a) SEQ ID NOs: 241-242; (b) SEQ ID NOs: 247-248; (c) SEQ ID NOs: 249-250; (d) SEQ ID NOs: 251-252; or (e) SEQ ID NOs: 263-264. In various aspects, the CD112R antigen binding protein comprises a FL LC amino acid sequence having an odd numbered SEQ ID NO. listed in the "Engineered*" column of Table C1 and a FL HC amino acid sequence having a SEQ ID NO. one greater than the FL LC SEQ ID NO. In various aspects, the CD112R antigen binding protein comprises at least a portion of a sequence of any one of the SEQ ID NOs: of Table C1, wherein the portion comprises the first 100 amino acids of the amino acid sequence, the first 105 amino acids of the amino acid sequence, the first 110 amino acids of the amino acid sequence, the first 115 amino acids of the amino acid sequence, or the first 120 amino acids of the amino acid sequence. In various instances, the CD112R antigen binding protein comprises at least 2, 3, 4, 5, or 6 of the CDRs of the amino acid sequence of Table C1. CDRs of a given antibody HC or LC may be determined by any one or more methods known in the art. See, e.g., Kabat et al., Sequences of Proteins of Immunological Interest, U.S. Dept. of Health and Human Services, NIH (1991); Chothia et al., J Mol Biol 196: 901-917 (1987); A1-Lazikani et al., J Mol Biol 273: 927-948 (1997); Abhinandan et al., Mol Immunol 45: 3832-3839 (2008); Lefranc et al., The Immunologist 7: 132-136 (1999); Lefranc et al., Dev Comp Immunol 27: 55-77 (2003); and Honegger et al., J Mol Biol 309: 657-670 (2001).

TABLE C1

SEQ ID NOs: of Consensus FL HC and LC of CD112R antigen binding proteins and Engineered Versions Thereof

| | Consensus FL HC | Consensus FL LC | Engineered* |
|---|---|---|---|
| 29E10 | 241 | 242 | 509-614 |
| 1E1 | 247 | 248 | 265-336, 661-936 |
| 24F1 | 249 | 250 | 413-508 |
| 11E4 | 251 | 252 | 337-412, 619-636 |
| 31B3 | 263 | 264 | 615-618 |

*Engineered FL LC are odd numbers and FL HC are even numbers.

In various aspects, the TIGIT antigen binding protein (e.g., an antibody or antigen binding fragment thereof) comprises a variant sequence of a HC variable region amino acid sequence or a variant sequence of a LC variable region amino acid sequence listed in Table B2 which variant sequence differs from the sequence of Table B2 by only 1 to 12 amino acids or which has at least or about 70% sequence identity (e.g., at least or about 80% sequence identity, at least or about 90% sequence identity, at least or about 95% sequence identity). In various aspects, the TIGIT antigen binding protein comprises a variant sequence of a FL HC amino acid sequence or a variant sequence of a FL LC amino acid sequence listed in Table B2 which variant sequence differs from the sequence of Table B2 by only 1 to 46 amino acids or which has at least or about 70% sequence identity (e.g., at least or about 80% sequence identity, at least or about 90% sequence identity, at least or about 95% sequence identity). In exemplary embodiments, the TIGIT antigen binding protein comprises a pair of HC variable region and LC variable region amino acid sequences listed in a single row of Table C2 or comprising one of the following pairs of amino acid sequences: (a) the first 100 amino acids of each of (a) SEQ ID NOs: 239 and 240; (b) the first 100 amino acids of each of SEQ ID NOs: 243 and 244; (c) the first 100 amino acids of each of SEQ ID NOs: 245 and 246; (d) the first 100 amino acids of each of SEQ ID NOs: 253 and 254; (e) the first 100 amino acids of each of SEQ ID NOs: 255 and 256; (f) the first 100 amino acids of each of SEQ ID NOs: 257 and 258, (g) the first 100 amino acids of each of SEQ ID NOs: 259 and 260, or (h) the first 100 amino acids of each of SEQ ID NOs: 261 and 262. In exemplary aspects, the CD112R antigen binding protein comprises the first 105, first 106, first 107, first 108, first 109, first 110, first 111, first 112, first 113, first 114, or first 115 amino acids of SEQ ID NO: 240, SEQ ID NO: 244, SEQ ID NIO: 246, SEQ ID NO: 254, SEQ ID NO: 256, SEQ ID NO: 258, SEQ ID NO: 260, or SEQ ID NO: 262, and/or the first 115, first 116, first 117, first 118, first 119, first 120, first 121, first 122, first 123, first 124, first 125, first 126, or first 127 amino acids of SEQ ID NO: 239, SEQ ID NO: 243, SEQ ID NIO: 245, SEQ ID NO: 253, SEQ ID NO: 255, SEQ ID NO: 257, SEQ ID NO: 259, or SEQ ID NO: 261. In exemplary embodiments, the TIGIT antigen binding protein comprises a pair of full-length (FL) HC and FL LC amino acid sequences listed in a single row of Table C2 or comprising one of the following pairs of amino acid sequences: (a) SEQ ID NOs: 239-240; (b) SEQ ID NOs: 243-244; (c) SEQ ID NOs: 245-246; (d) SEQ ID NOs: 253-254; (e) SEQ ID NOs: 255-256; (f) SEQ ID NOs: 257-258, (g) SEQ ID NOs: 259-260, or (h) SEQ ID NOs: 261-262. In various aspects, the TIGIT antigen binding protein comprises a FL LC amino acid sequence having an odd numbered SEQ ID NO. listed in the "Engineered*" column of Table C2 and a FL HC amino acid sequence having a SEQ ID NO. one greater than the FL LC SEQ ID NO. In various aspects, the TIGIT antigen binding protein comprises at least a portion of a sequence of any one of the SEQ ID NOs: of Table C2, wherein the portion comprises the first 100 amino acids of the amino acid sequence, the first 105 amino acids of the amino acid sequence, the first 110 amino acids of the amino acid sequence, the first 115 amino acids of the amino acid sequence, or the first 120 amino acids of the amino acid sequence. In various instances, the TIGIT antigen binding protein comprises at least 2, 3, 4, 5, or 6 of the CDRs of the amino acid sequence of Table C2. CDRs of a given antibody HC or LC may be determined by any one or more methods known in the art.

TABLE C2

SEQ ID NOs: of Consensus FL HC and FL LC of TIGIT antigen binding proteins and Engineered Versions Thereof

| | Consensus FL HC | Consensus FL LC | Engineered* |
|---|---|---|---|
| 66H9 | 239 | 240 | 655-660, 1953-1964 |
| 43B7 | 243 | 244 | 637-644, 937-1312, 1735-1736, 1825-1862 |
| 58A7 | 245 | 246 | 1313-1734, 1737-1740, 1929-1952, 1967-1968 |

TABLE C2-continued

SEQ ID NOs: of Consensus FL HC and FL LC of TIGIT antigen
binding proteins and Engineered Versions Thereof

| | Consensus FL HC | Consensus FL LC | Engineered* |
|---|---|---|---|
| 4G10 | 253 | 254 | 1863-1912 |
| 28B8 | 255 | 256 | 1767-1780 |
| 55G7 | 257 | 258 | 645-654, 1913-1928 |
| 11A3 | 259 | 260 | 1741-1766 |
| 39D2 | 261 | 262 | 1781-1824, 1965-1966 |

*Engineered FL LC are odd numbers and FL HC are even numbers.

In various aspects, the CD112R antigen binding protein (e.g., an antibody or antigen binding fragment thereof) comprises an antibody, antigen-binding fragment of an antibody (e.g., Fab), or an antibody protein product, e.g., an scFv. In various aspects, the CD112R antigen binding protein is bivalent comprising two antigen binding sites. In various aspects, the TIGIT antigen binding protein comprises an antibody, antigen-binding fragment of an antibody (e.g., Fab), or an antibody protein product, e.g., an scFv. In various aspects, the TIGIT antigen binding protein is bivalent comprising two antigen binding sites.

In exemplary aspects, the TIGIT antigen binding protein, e.g., anti-TIGIT antibody, comprises a LC variable region amino acid sequence which is highly similar to SEQ ID NO: 192 or SEQ ID NO: 222 or the first 105-115 amino acids of SEQ ID NO: 240 (e.g., at least or about 70% sequence identity (e.g., at least or about 80% sequence identity, at least or about 90% sequence identity, at least or about 95% sequence identity) and the LC variable region amino acid sequence comprises a glutamic acid at position 1 (Glu1), or a conservative amino acid substitution thereof, a glutamine at position 27 (Gln27), or a conservative amino acid substitution thereof, a serine at position 28 (Ser28), or a conservative amino acid substitution thereof, a serine at position 91 (Ser91), or a conservative amino acid substitution thereof, a serine at position 92 (Ser92), or a conservative amino acid substitution thereof, a serine at position 93 (Ser93), or a conservative amino acid substitution thereof, a leucine at position 94 (Leu94), or a conservative amino acid substitution thereof, or any combination thereof. In exemplary aspects, the TIGIT antigen binding protein, e.g., anti-TIGIT antibody, comprises a LC CDR1 amino acid sequence comprising Gln27, or a conservative amino acid substitution thereof, Ser28, or a conservative amino acid substitution thereof, or any combination thereof. In exemplary aspects, the TIGIT antigen binding protein, e.g., anti-TIGIT antibody, comprises a LC CDR2 amino acid sequence comprising Glu1, or a conservative amino acid substitution thereof. In exemplary aspects, the TIGIT antigen binding protein, e.g., anti-TIGIT antibody, comprises a LC CDR3 amino acid sequence comprising Ser91, or a conservative amino acid substitution thereof, Ser92, or a conservative amino acid substitution thereof, Ser93, or a conservative amino acid substitution thereof, Leu94, or a conservative amino acid substitution thereof, or any combination thereof. In exemplary aspects, the TIGIT antigen binding protein, e.g., anti-TIGIT antibody, comprises a LC variable region amino acid sequence comprising Gln27, or a conservative amino acid substitution thereof, which forms a hydrogen bond with an amino acid of TIGIT. In various aspects, when the TIGIT antigen binding protein, e.g., TIGIT antibody, is bound to TIGIT, the amino acid residues named above are positioned about 3 angstroms to about 4 angstroms from an amino acid of TIGIT.

In exemplary aspects, the TIGIT antigen binding protein, e.g., anti-TIGIT antibody, comprises a HC variable region amino acid sequence which is highly similar to SEQ ID NO: 191 or SEQ ID NO: 221 or the first 115-127 amino acids of SEQ ID NO: 239 (e.g., at least or about 70% sequence identity (e.g., at least or about 80% sequence identity, at least or about 90% sequence identity, at least or about 95% sequence identity)) and comprises a valine at position 32 (Val32), or a conservative amino acid substitution thereof, a tyrosine at position 33 (Tyr33), or a conservative amino acid substitution thereof, a tyrosine at position 52 (Tyr52), or a conservative amino acid substitution thereof, a tyrosine at position 54 (Tyr54), or a conservative amino acid substitution thereof, a tyrosine at position 55 (Tyr55), or a conservative amino acid substitution thereof, a serine at position 56 (Ser56), or a conservative amino acid substitution thereof, a glycine at position 57 (Gly57), or a conservative amino acid substitution thereof, a glycine at position 58 (Gly58), or a conservative amino acid substitution thereof, a threonine at position 59 (Thr59), or a conservative amino acid substitution thereof, a tyrosine at position 60 (Tyr60), or a conservative amino acid substitution thereof, a proline at position 63 (Pro63), or a conservative amino acid substitution thereof, an arginine at position 66 (Arg66), or a conservative amino acid substitution thereof, an isoleucine at position 102 (Ile102), or a conservative amino acid substitution thereof, an alanine at position 104 (Ala104), or a conservative amino acid substitution thereof, a glycine at position 107 (Gly107), or a conservative amino acid substitution thereof, a tyrosine at position 108 (Tyr108), or a conservative amino acid substitution thereof, a phenylalanine at position 109 (Phe109), or a conservative amino acid substitution thereof, a tyrosine at position 110 (Tyr110), or a conservative amino acid substitution thereof, a tyrosine at position 111 (Tyr111), or a conservative amino acid substitution thereof, or any combination thereof. In exemplary aspects, the TIGIT antigen binding protein, e.g., anti-TIGIT antibody, comprises a HC CDR1 amino acid sequence comprising Val32, or a conservative amino acid substitution thereof, Tyr33, or a conservative amino acid substitution thereof, or any combination thereof. In exemplary aspects, the TIGIT antigen binding protein, e.g., anti-TIGIT antibody, comprises a HC CDR2 amino acid sequence comprising Tyr52, or a conservative amino acid substitution thereof, Tyr54, or a conservative amino acid substitution thereof, Tyr55, or a conservative amino acid substitution thereof, Ser56, or a conservative amino acid substitution thereof, Gly57, or a conservative amino acid substitution thereof, Gly58, or a conservative amino acid substitution thereof, Thr59, or a conservative amino acid substitution thereof, Tyr60, or a conservative amino acid substitution thereof, Pro63, or a conservative amino acid substitution thereof, Arg66, or a conservative amino acid substitution thereof, or any combination thereof. In exemplary aspects, the TIGIT antigen binding protein, e.g., anti-TIGIT antibody, comprises a HC CDR3 amino acid sequence comprising Ile102, or a conservative amino acid substitution thereof, Ala104, or a conservative amino acid substitution thereof, Gly107, or a conservative amino acid substitution thereof, Tyr108, or a conservative amino acid substitution thereof, Phe109, or a conservative amino acid substitution thereof, Tyr110, or a conservative amino acid substitution thereof, Tyr111, or a conservative amino acid substitution thereof, or any combination thereof. In various aspects, each of Tyr52, Ser56, Thr59, Phe109, Tyr55, Tyr60, or a conservative amino acid substitution thereof, forms a hydrogen bond with an amino acid of TIGIT. In various aspects, when the TIGIT antigen binding protein, e.g., TIGIT antibody, is bound to TIGIT, each of the amino acid residues named above are positioned about 3 angstroms to about 4 angstroms from an amino acid of TIGIT. In exemplary aspects, the TIGIT antigen binding protein, e.g., anti-TIGIT antibody, comprises a HC variable region amino acid sequence comprising Arg66, or a conservative amino acid substitution thereof, which forms a salt bridge with an amino acid of TIGIT. In various aspects, Tyr52 and Thr59 form a hydrogen bond with the same amino acid of TIGIT. In various instances, Ser56 forms a hydrogen bond with two different amino acids of TIGIT.

In exemplary aspects, the TIGIT antigen binding protein, e.g., anti-TIGIT antibody, comprises a LC variable region amino acid sequence which is highly similar to SEQ ID NO: 122 or 212 or 2012 or the first 105-115 amino acids of SEQ ID NO: 246 (e.g., at least or about 70% sequence identity (e.g., at least or about 80% sequence identity, at least or about 90% sequence identity, at least or about 95% sequence identity) and comprises a glutamic acid at position 1 (Glu1), or a conservative amino acid substitution thereof, an isoleucine at position 2 (Ile2), or a conservative amino acid substitution thereof, a glutamine at position 27 (Gln27), or a conservative amino acid substitution thereof, a serine at position 28 (Ser28), or a conservative amino acid substitution thereof, a valine at position 29 (Val29), or a conservative amino acid substitution thereof, a serine at position 30 (Ser30), or a conservative amino acid substitution thereof, a serine at position 31 (Ser31), or a conservative amino acid substitution thereof, a threonine at position 32 (Thr32), or a conservative amino acid substitution thereof, a tyrosine at position 33 (Tyr33), or a conservative amino acid substitution thereof, a serine at position 68 (Ser68), or a conservative amino acid substitution thereof, a glycine at position 69 (Gly69), or a conservative amino acid substitution thereof, a tyrosine at position 92 (Tyr92), or a conservative amino acid substitution thereof, aspartate at position 93 (Asp93), or a conservative amino acid substitution thereof, a valine at position 94 (Val94), or a conservative amino acid substitution thereof, a serine at position 95 (Ser95), or a conservative amino acid substitution thereof, a proline at position 96 (Pro96), or a conservative amino acid substitution thereof, a tryptophan at position 97 (Trp97), or a conservative amino acid substitution thereof, or any combination thereof. In exemplary aspects, the TIGIT antigen binding protein, e.g., anti-TIGIT antibody, comprises a LC CDR1 amino acid sequence comprising Gln27, or a conservative amino acid substitution thereof, Ser28, or a conservative amino acid substitution thereof, Val29, or a conservative amino acid substitution thereof, Ser30, or a conservative amino acid substitution thereof, Ser31, or a conservative amino acid substitution thereof, Thr32, or a conservative amino acid substitution thereof, Tyr33, or a conservative amino acid substitution thereof, or any combination thereof. In exemplary aspects, the TIGIT antigen binding protein, e.g., anti-TIGIT antibody, comprises a LC CDR2 amino acid sequence comprising Glu1, or a conservative amino acid substitution thereof, Ile2, or a conservative amino acid substitution thereof, Ser68, or a conservative amino acid substitution thereof, Gly69, or a conservative amino acid substitution thereof, or any combination thereof. In exemplary aspects, the TIGIT antigen binding protein, e.g., anti-TIGIT antibody, comprises a LC CDR3 amino acid sequence comprising Tyr92, or a conservative amino acid substitution thereof, Asp93, or a conservative amino acid substitution thereof, Val94, or a conservative amino acid substitution thereof, Ser95, or a conservative amino acid substitution thereof, Pro96, or a conservative amino acid substitution thereof, Trp97, or a conservative amino acid substitution thereof, or any combination thereof. In exemplary aspects, the TIGIT antigen binding protein, e.g., anti-TIGIT antibody, comprises a LC variable region amino acid sequence comprising Asp93, or a conservative amino acid substitution thereof, Ser95, or a conservative amino acid substitution thereof, Try33, or a conservative amino acid substitution thereof, each of which forms a hydrogen bond with an amino acid of TIGIT. In exemplary aspects, the TIGIT antigen binding protein, e.g., anti-TIGIT antibody, comprises a LC variable region amino acid sequence comprising Asp93, or a conservative amino acid substitution thereof, which forms a salt bridge with an amino acid of TIGIT. In various aspects, when the TIGIT antigen binding protein, e.g., TIGIT antibody, is bound to TIGIT, the amino acid residues named above are positioned about 3 angstroms to about 4 angstroms from an amino acid of TIGIT.

In exemplary aspects, the TIGIT antigen binding protein, e.g., anti-TIGIT antibody, comprises a HC variable region amino acid sequence which is highly similar to SEQ ID NO: 121 or 211 or the first 115-127 amino acids of SEQ ID NO: 245 (e.g., at least or about 70% sequence identity (e.g., at least or about 80% sequence identity, at least or about 90% sequence identity, at least or about 95% sequence identity) and a glycine at position 32 (Gly32), or a conservative amino acid substitution thereof, a tyrosine at position 35 (Tyr35), or a conservative amino acid substitution thereof, a tyrosine at position 52 (Tyr52), or a conservative amino acid substitution thereof, a tyrosine at position 54 (Tyr54), or a conservative amino acid substitution thereof, a tyrosine at position 55 (Tyr55), or a conservative amino acid substitution thereof, a serine at position 56 (Ser56), or a conservative amino acid substitution thereof, a serine at position 58 (Ser58), or a conservative amino acid substitution thereof, a threonine at position 59 (Thr59), or a conservative amino acid substitution thereof, a phenylalanine at position 60 (Phe60), or a conservative amino acid substitution thereof, a proline at position 63 (Pro63), or a conservative amino acid substitution thereof, an lysine at position 66 (Lys66), or a conservative amino acid substitution thereof, an arginine at position 102 (Arg102), or a conservative amino acid substitution thereof, an asparagine at position 104 (Asn104), or a conservative amino acid substitution thereof, a tryptophan at position 105 (Trp105), or a conservative amino acid substitution thereof, an asparagine at position 106 (Asn106), or a conservative amino acid substitution thereof, a tyrosine at position 107 (Tyr107), or a conservative amino acid substitution thereof, or any combination thereof. In exemplary aspects, the TIGIT antigen binding protein, e.g., anti-TIGIT antibody, comprises a HC CDR1 amino acid sequence comprising Gly32, or a conservative amino acid substitution thereof, Tyr35, or a conservative amino acid substitution thereof, or any combination thereof. In exemplary aspects, the TIGIT antigen binding protein, e.g., anti-TIGIT antibody, comprises a HC CDR2 amino acid sequence comprising Tyr52, or a conservative amino acid substitution thereof, Tyr54, or a conservative amino acid substitution thereof, Tyr55, or a conservative amino acid substitution thereof, Ser56, or a conservative amino acid substitution thereof, Ser58, or a conservative amino acid substitution thereof, Thr59, or a conservative amino acid substitution thereof, Phe60, or a conservative amino acid substitution thereof, Pro63, or a conservative amino acid substitution thereof, Lys66, or a conservative amino acid substitution thereof, or any combination thereof. In exemplary aspects, the TIGIT antigen binding protein, e.g., anti-TIGIT antibody, comprises a HC CDR3 amino acid sequence comprising Arg102, or a conservative amino acid substitution thereof, Asn104, or a conservative amino acid substitution thereof, Trp105, or a conservative amino acid substitution thereof, Asn106, or a conservative amino acid substitution thereof, Tyr107, or a conservative amino acid substitution thereof, or any combination thereof. In various aspects, each of Ser58, Asn106, Tyr107, Tyr35, Arg102, and Ser56, or a conservative amino acid substitution thereof, forms a hydrogen bond with an amino acid of TIGIT. In various aspects, when the TIGIT antigen binding protein, e.g., TIGIT antibody, is bound to TIGIT, each of the amino acid residues named above are positioned about 3 angstroms to about 4 angstroms from an amino acid of TIGIT.

In exemplary aspects, the TIGIT antigen binding protein, e.g., anti-TIGIT antibody, comprises a LC variable region amino acid sequence which is highly similar to SEQ ID NO: 162 or the first 105-115 amino acids of SEQ ID NO: 262 (e.g., at least or about 70% sequence identity (e.g., at least or about 80% sequence identity, at least or about 90% sequence identity, at least or about 95% sequence identity) and comprises an arginine at position 30 (Arg30), or a conservative amino acid substitution thereof, an arginine at position 31 (Arg31), or a conservative amino acid substitution thereof, a tyrosine at position 32 (Tyr32), or a conservative amino acid substitution thereof, a serine at position 91 (Ser91), or a conservative amino acid substitution thereof, a tyrosine at position 92 (Tyr92), or a conservative amino acid substitution thereof, a serine at position 93 (Ser93), or a conservative amino acid substitution thereof, a threonine at position 94 (Thr94), or a conservative amino acid substitution thereof, or any combination thereof. In exemplary aspects, the TIGIT antigen binding protein, e.g., anti-TIGIT antibody, comprises a LC CDR1 amino acid sequence comprising Arg30, or a conservative amino acid substitution thereof, Arg31, or a conservative amino acid substitution thereof, Tyr32, or a conservative amino acid substitution thereof, or any combination thereof. In exemplary aspects, the TIGIT antigen binding protein, e.g., anti-TIGIT antibody, comprises a LC CDR3 amino acid sequence comprising Ser91, or a conservative amino acid substitution thereof, Tyr92, or a conservative amino acid substitution thereof, Ser93, or a conservative amino acid substitution thereof, Thr94, or a conservative amino acid substitution thereof, or any combination thereof. In exemplary aspects, the TIGIT antigen binding protein, e.g., anti-TIGIT antibody, comprises a LC variable region amino acid sequence comprising Tyr32, Tyr92, Thr94, Arg30, Arg31, or a conservative amino acid substitution thereof, each of which forms a hydrogen bond with an amino acid of TIGIT. In exemplary aspects, the TIGIT antigen binding protein, e.g., anti-TIGIT antibody, comprises a LC variable region amino acid sequence comprising Arg30, or a conservative amino acid substitution thereof, which forms a salt bridge with an amino acid of TIGIT. In various aspects, when the TIGIT antigen binding protein, e.g., TIGIT antibody, is bound to TIGIT, the amino acid residues named above are positioned about 3 angstroms to about 4 angstroms from an amino acid of TIGIT.

In exemplary aspects, the TIGIT antigen binding protein, e.g., anti-TIGIT antibody, comprises a HC variable region amino acid sequence which is highly similar to SEQ ID NO: 161 or the first 115-127 amino acids of SEQ ID NO: 261 (e.g., at least or about 70% sequence identity (e.g., at least or about 80% sequence identity, at least or about 90% sequence identity, at least or about 95% sequence identity) and a threonine at position 30 (Thr30), or a conservative amino acid substitution thereof, a glycine at position 31 (Gly31), or a conservative amino acid substitution thereof, a tyrosine at position 32 (Tyr32), or a conservative amino acid substitution thereof, a tyrosine at position 33 (Tyr33), or a conservative amino acid substitution thereof, a tryptophan at position 47 (Trp47), or a conservative amino acid substitution thereof, a tryptophan[at position 50 (Trp50), or a conservative amino acid substitution thereof, a serine at position 52 (Ser52), or a conservative amino acid substitution thereof, a threonine at position 54 (Thr54), or a conservative amino acid substitution thereof, a serine at position 55 (Ser55), or a conservative amino acid substitution thereof, an alanine at position 57 (Ala57), or a conservative amino acid substitution thereof, a threonine at position 58 (Thr58), or a conservative amino acid substitution thereof, a glycine at position 59 (Gly59), or a conservative amino acid substitution thereof, a tyrosine at position 60 (Tyr60), or a conservative amino acid substitution thereof, a glutamine at position 65 (Gln65), or a conservative amino acid substitution thereof, an asparagine at position 101 (Asn101), or a conservative amino acid substitution thereof, a serine at position 102 (Ser102), or a conservative amino acid substitution thereof, a valine at position 103 (Val103), or a conservative amino acid substitution thereof, a leucine at position 104 (Leu104) or a conservative amino acid substitution thereof, a tyrosine at position 105 (Tyr105), or a conservative amino acid substitution thereof, a tyrosine at position 106 (Tyr106), or a conservative amino acid substitution thereof, a tyrosine at position 107 (Tyr107), or a conservative amino acid substitution thereof, or any combination thereof. In exemplary aspects, the TIGIT antigen binding protein, e.g., anti-TIGIT antibody, comprises a HC CDR1 amino acid sequence comprising Thr30, or a conservative amino acid substitution thereof, Gly31 or a conservative amino acid substitution thereof, Tyr32, or a conservative amino acid substitution thereof, Tyr33, or a conservative amino acid substitution thereof, or any combination thereof. In exemplary aspects, the TIGIT antigen binding protein, e.g., anti-TIGIT antibody, comprises a HC CDR2 amino acid sequence comprising Trp47, or a conservative amino acid substitution thereof, a Trp50, or a conservative amino acid substitution thereof, Ser52, or a conservative amino acid substitution thereof, Thr54, or a conservative amino acid substitution thereof, Ser55, or a conservative amino acid substitution thereof, Ala57, or a conservative amino acid substitution thereof, Thr58, or a conservative amino acid substitution thereof, Gly59, or a conservative amino acid substitution thereof, Tyr60, or a conservative amino acid substitution thereof, Gln65, or a conservative amino acid substitution thereof, or any combination thereof. In exemplary aspects, the TIGIT antigen binding protein, e.g., anti-TIGIT antibody, comprises a HC CDR3 amino acid sequence comprising Asn101, or a conservative amino acid substitution thereof, Ser102, or a conservative amino acid substitution thereof, Val103, or a conservative amino acid substitution thereof, Leu104, or a conservative amino acid substitution thereof, Tyr105, or a conservative amino acid substitution thereof, Tyr106, or a conservative amino acid substitution thereof, Tyr107, or a conservative amino acid substitution thereof, or any combination thereof. In various aspects, each of Leu104, Tyr33, Asn101, Tyr107, Tyr60, Ser55, Ser52, or a conservative amino acid substitution thereof, forms a hydrogen bond with an amino acid of TIGIT. In various aspects, when the TIGIT antigen binding protein, e.g., TIGIT antibody, is bound to TIGIT, each of the amino acid residues named above are positioned about 3 angstroms to about 4 angstroms from an amino acid of TIGIT.

In exemplary aspects, the TIGIT antigen binding protein, e.g., anti-TIGIT antibody, comprises a LC variable region amino acid sequence which is highly similar to SEQ ID NO: 132 or the first 105-115 amino acids of SEQ ID NO: 254 (e.g., at least or about 70% sequence identity (e.g., at least or about 80% sequence identity, at least or about 90% sequence identity, at least or about 95% sequence identity) and comprises a glutamine at position 27 (Gln27), or a conservative amino acid substitution thereof, a leucine at position 30 (Leu30), or a conservative amino acid substitution thereof, a serine at position 32 (Ser32), or a conservative amino acid substitution thereof, a serine at position 96 (Ser96), or a conservative amino acid substitution thereof, an isoleucine at position 97 (Ile97), or a conservative amino acid substitution thereof, a glutamine at position 98 (Gln98), or a conservative amino acid substitution thereof, a leucine at position 99 (Leu99), or a conservative amino acid substitution thereof, or any combination thereof. In exemplary aspects, the TIGIT antigen binding protein, e.g., anti-TIGIT antibody, comprises a LC CDR1 amino acid sequence comprising Gln27, or a conservative amino acid substitution thereof, Leu30, or a conservative amino acid substitution thereof, Ser32, or a conservative amino acid substitution thereof, or any combination thereof. In exemplary aspects, the TIGIT antigen binding protein, e.g., anti-TIGIT antibody, comprises a LC CDR3 amino acid sequence comprising Ser96, or a conservative amino acid substitution thereof, Ile97, or a conservative amino acid substitution thereof, Gln98, or a conservative amino acid substitution thereof, Leu99, or a conservative amino acid substitution thereof, or any combination thereof. In exemplary aspects, the TIGIT antigen binding protein, e.g., anti-TIGIT antibody, comprises a LC variable region amino acid sequence comprising Ser32, or a conservative amino acid substitution thereof, and/or Gln98, or a conservative amino acid substitution thereof, each of which forms a hydrogen bond with an amino acid of TIGIT. In various aspects, when the TIGIT antigen binding protein, e.g., TIGIT antibody, is bound to TIGIT, the amino acid residues named above are positioned about 3 angstroms to about 4 angstroms from an amino acid of TIGIT.

In exemplary aspects, the TIGIT antigen binding protein, e.g., anti-TIGIT antibody, comprises a HC variable region amino acid sequence which is highly similar to SEQ ID NO: 131 or the first 115-127 amino acids of SEQ ID NO: 253 (e.g., at least or about 70% sequence identity (e.g., at least or about 80% sequence identity, at least or about 90% sequence identity, at least or about 95% sequence identity) and an aspartate at position 33 (Asp33), or a conservative amino acid substitution thereof, a tyrosine at position 52 (Tyr52), or a conservative amino acid substitution thereof, a tyrosine at position 54 (Tyr54), or a conservative amino acid substitution thereof, a tyrosine at position 55 (Tyr55), or a conservative amino acid substitution thereof, a serine at position 56 (Ser56), or a conservative amino acid substitution thereof, a glycine at position 57 (Gly57), or a conservative amino acid substitution thereof, a glycine at position 58 (Gly58), or a conservative amino acid substitution thereof, a threonine at position 59 (Thr59), or a conservative amino acid substitution thereof, a tyrosine at position 60 (Tyr60), or a conservative amino acid substitution thereof, a proline at position 63 (Pro63), or a conservative amino acid substitution thereof, a lysine at position 66 (Lys66), or a conservative amino acid substitution thereof, an isoleucine at position 102 (Ile102), or a conservative amino acid substitution thereof, an alanine at position 104 (Ala104), or a conservative amino acid substitution thereof, a glycine at position 107 (Gly107), or a conservative amino acid substitution thereof, a tyrosine at position 108 (Tyr108), or a conservative amino acid substitution thereof, a phenylalanine at position 109 (Phe109), or a conservative amino acid substitution thereof, a tyrosine at position 110 (Tyr110), or a conservative amino acid substitution thereof, a phenylalanine at position 111 (Phe111) or a conservative amino acid substitution thereof, or any combination thereof. In exemplary aspects, the TIGIT antigen binding protein, e.g., anti-TIGIT antibody, comprises a HC CDR1 amino acid sequence comprising Asp33, or a conservative amino acid substitution thereof. In exemplary aspects, the TIGIT antigen binding protein, e.g., anti-TIGIT antibody, comprises a HC CDR2 amino acid sequence comprising Tyr52, or a conservative amino acid substitution thereof, a Tyr54, or a conservative amino acid substitution thereof, Tyr55, or a conservative amino acid substitution thereof, Ser56, or a conservative amino acid substitution thereof, Gly57, or a conservative amino acid substitution thereof, Gly58, or a conservative amino acid substitution thereof, Thr59, or a conservative amino acid substitution thereof, Tyr60, or a conservative amino acid substitution thereof, Pro63, or a conservative amino acid substitution thereof, Lys66, or a conservative amino acid substitution thereof, or any combination thereof. In exemplary aspects, the TIGIT antigen binding protein, e.g., anti-TIGIT antibody, comprises a HC CDR3 amino acid sequence comprising Ile102, or a conservative amino acid substitution thereof, Ala104, or a conservative amino acid substitution thereof, Gly107, or a conservative amino acid substitution thereof, Tyr108, or a conservative amino acid substitution thereof, Phe109, or a conservative amino acid substitution thereof, Tyr110, or a conservative amino acid substitution thereof, Phe111, or a conservative amino acid substitution thereof, or any combination thereof. In various aspects, each of Tyr52, Ser56, Thr59, Tyr60, Phe109, Tyr54, Tyr55, Lys66, or a conservative amino acid substitution thereof, forms a hydrogen bond with an amino acid of TIGIT. In various aspects, when the TIGIT antigen binding protein, e.g., TIGIT antibody, is bound to TIGIT, each of the amino acid residues named above are positioned about 3 angstroms to about 4 angstroms from an amino acid of TIGIT.

In exemplary aspects, the antigen binding protein comprises a heavy chain amino acid sequence which comprises a set of charge pair mutations, as described herein. In particular aspects, the heavy chain amino acid sequence comprises charge pair mutations selected from V1, V103, and V131 charge pair mutations.

In additional exemplary aspects, the antigen binding protein comprises one or more amino acid modifications, relative to the naturally-occurring counterpart, in order to improve half-life/stability or to render the antibody more suitable for expression/manufacturability. In exemplary instances, the antigen binding protein is designed to prevent or reduce interaction between the Fc and Fc receptors. In exemplary instances, the antigen binding protein is a Stable Effector Functionless (SEFL) antibody comprising a constant region that lacks the ability to interact with Fcγ receptors. SEFL antibodies are known in the art. See, e.g., Liu et al., J Biol Chem 292: 1876-1883 (2016); and Jacobsen et al., J. Biol. Chem. 292: 1865-1875 (2017). In exemplary aspects, the SEFL antibody comprises one or more of the following mutations, numbered according to the EU system: L242C, A287C, R292C, N297G, V302C, L306C, and/or K334C. In exemplary aspects, the SEFL antibody comprises N297G. In exemplary aspects, the SEFL antibody comprises A287C, N297G, and L306C. In other exemplary aspects, the SEFL antibody comprises R292C, N297G, and V302C (i.e., SEFL2-2). In various aspects, the antigen binding protein comprises a heavy chain comprising the amino acid sequence of SEQ ID NO: 2019 optionally SEQ ID NO: 2020.

In various aspects, the antigen-binding protein is an antibody comprising a HC variable region encoded by a V gene segment of the VH1, VH3, or VH4 family of gene segments. In various aspects, the antigen-binding protein is an antibody comprising a HC variable region encoded by a D gene segment of the D1, D3, D5, D6 or D7 family of gene segments. In various aspects, the antigen-binding protein is an antibody comprising a HC variable region encoded by a J gene segment of the JH4 or JH6 family of gene segments. Optionally, the antigen-binding protein is an antibody comprising a HC variable region encoded by a V gene segment of the VH3 family of gene segments and a D gene segment of the D1, D3, or D6 family of gene segments, and/or a J gene segment of the JH4 or JH6 family of gene segments. In various instances, the antigen-binding protein is an antibody comprising a HC variable region encoded by a V gene segment of the VH3 family of gene segments, a D gene segment of the D1 family of gene, and a J gene segment of the JH6 family of gene segments. In various instances, the antigen-binding protein is an antibody comprising a HC variable region encoded by a V gene segment of the VH3 family of gene segments, a D gene segment of the D3 family of gene, and a J gene segment of the JH6 family of gene segments. In various instances, the antigen-binding protein is an antibody comprising a HC variable region encoded by a V gene segment of the VH3 family of gene segments, a D gene segment of the D6 family of gene, and a J gene segment of the JH6 family of gene segments. In various instances, the antigen-binding protein is an antibody comprising a HC variable region encoded by a V gene segment of the VH1 family of gene segments, a D gene segment of the D5 family of gene, and a J gene segment of the JH6 family of gene segments. In various instances, the antigen-binding protein is an antibody comprising a HC variable region encoded by a V gene segment of the VH4 family of gene segments, a D gene segment of the D7 family of gene, and a J gene segment of the JH6 family of gene segments. In various instances, the antigen-binding protein is an antibody comprising a HC variable region encoded by a V gene segment of the VH3 family of gene segments, a D gene segment of the D1 family of gene, and a J gene segment of the JH4 family of gene segments.

Polypeptides

Provided herein are polypeptides comprising, consisting essentially of, or consisting of one or more of the amino acid sequence(s) of Table A1 or Table A2 or Table B1 or Table B2 or Table C1 or Table C2. In various aspects, the polypeptide comprises six of the CDRs of Table A1 or Table A2 with intervening amino acids. In various aspects, the polypeptide comprises only one of the HC variable or LC variable amino acid sequences of Table B1 or Table B2. In various aspects, the polypeptide comprises both the HC variable and LC variable amino acid sequences of Table B1 or Table B2 fused as one sequence, optionally, wherein the HC variable and LC variable amino acid sequences are linked together by a linker sequence. In various instances, the polypeptide comprises two copies of the HC variable region sequence and two copies of the LC variable region sequences, optionally, linked together with linker sequences. In some aspects, the polypeptide comprises the amino acid sequence of an scFv$_1$ an scFv$_2$ or an (scFv)$_2$. In some aspects, the polypeptide comprises the amino acid sequence of a diabody, triabody, single domain antibody, single variable domain, tandem scFv, tascFvs, and the like. In various aspects, the polypeptide comprises only one of the FL HC or FL LC amino acid sequences of Table B1 or Table B2 or Table C1 or Table C2. In various aspects, the polypeptide comprises both the FL HC and FL LC amino acid sequences of Table B1 or Table B2 or Table C1 or Table C2 fused as one sequence, optionally, wherein the FL HC and FL LC are linked together by a linker sequence. In exemplary aspects, the polypeptide comprises a variant sequence of a parent sequence comprising the amino acid sequence of Table A1 or Table A2 or Table B1 or Table B2 or Table C1 or Table C2. In various aspects, the polypeptide comprises an amino acid sequence which differs by only 1, 2, 3, 4, 5, 6, or more amino acids, relative to the parent sequence. In exemplary aspects, the polypeptide comprises a variant sequence which differs by only one or two amino acids, relative to the parent sequence. In exemplary aspects, the polypeptide comprises variant sequence having only 1, 2, 3, 4, 5, 6, or more conservative amino acid substitutions, relative to the above-referenced amino acid sequence(s).

In exemplary aspects, the polypeptide comprises an amino acid sequence which has greater than or about 30%, greater than or about 50%, or greater than or about 70% sequence identity to the parent amino acid sequence. In exemplary aspects, the polypeptide comprises an amino acid sequence which has at least 30%, at least 40%, at least 50%, at least 60%, at least 70%, at least 80%, at least 85%, at least 90% or has greater than 90% sequence identity to the parent sequence. In exemplary aspects, the antigen-binding protein comprises an amino acid sequence that has at least 70%, at least 80%, at least 85%, at least 90% or has greater than 90% sequence identity along the full-length of the parent sequence. In exemplary aspects, the polypeptide comprises an amino acid sequence having at least 95%, 96%, 97%, 98% or 99% sequence identity along the full-length of the parent sequence In alternative or additional embodiments of the present disclosure, the polypeptide is lipidated (e.g., myristoylated, palmitoylated), glycosylated, amidated, carboxylated, phosphorylated, esterified, acylated, acetylated, cyclized, or converted into an acid addition salt and/or optionally dimerized or polymerized, or conjugated, as further described herein.

Provided herein are peptidomimetics designed to mimic a polypeptide of the present disclosure. The peptidomimetics are substantially similar in structure to a polypeptide of the present disclosure but has at least one structural difference. For example, the peptidomimetic is a peptoid having one or more linkages in replacing one or more peptide linkages. In exemplary instances, the peptoid comprises a side chain that is connected to the nitrogen of the peptide backbone, instead of an α-carbon as in peptides. In some aspects, the peptoids of the present disclosure lack the amide hydrogen which is responsible for many of the secondary structure elements in peptides and proteins. See, e.g., Reyna et al., PNAS 89(20): 9367-9371 (1992).

Peptidomimetics as well as methods of making the same are known in the art. See, for example, *Advances in Amino Acid Mimetics and Peptidomimetics*, Volumes 1 and 2, ed., Abell, A., JAI Press Inc., Greenwich, C T, 2006. In some aspects, the peptidomimetic is a D-peptide peptidomimetic comprising D-isomer amino acids. In some aspects, the peptidomimetic is a peptoid in which the side chain of an amino acid is connected to the alpha nitrogen atom of the peptide backbone. Methods of making peptoids are known in the art. See, e.g., Zuckermann et al., *JACS* 114(26): 10646-10647 (1992) and *Design, Synthesis, and Evaluation of Novel Peptoids*, Fowler, Sarah, University of Wisconsin-Madison, 2008. In some aspects, the peptidomimetic is a β-peptide comprising β amino acids which have their amino group bonded to the β-carbon rather than the alpha carbon. Methods of making β-peptides are known in the art. See, for example, Seebach et al., *Helvetica Chimica Acta* 79(4): 913-941 (1996).

Aptamers

In exemplary embodiments, the antigen binding protein is an aptamer. Recent advances in the field of combinatorial sciences have identified short polymer sequences (e.g., oligonucleic acid or peptide molecules) with high affinity and specificity to a given target. For example, SELEX technology has been used to identify DNA and RNA aptamers with binding properties that rival mammalian antibodies, the field of immunology has generated and isolated antibodies or antibody fragments which bind to a myriad of compounds and phage display has been utilized to discover new peptide sequences with very favorable binding properties. Based on the success of these molecular evolution techniques, it is certain that molecules can be created which bind to any target molecule. A loop structure is often involved with providing the desired binding attributes as in the case of: aptamers which often utilize hairpin loops created from short regions without complimentary base pairing, naturally derived antibodies that utilize combinatorial arrangement of looped hyper-variable regions and new phage display libraries utilizing cyclic peptides that have shown improved results when compared to linear peptide phage display results. Thus, sufficient evidence has been generated to suggest that high affinity ligands can be created and identified by combinatorial molecular evolution techniques. For the present disclosure, molecular evolution techniques can be used to isolate compounds specific for TIGIT or CD112R that inhibit the binding interaction between TIGIT and CD155 or CD112R and CD112. For more on aptamers, see, generally, Gold, L., Singer, B., He, Y. Y., Brody. E., "Aptamers As Therapeutic And Diagnostic Agents," J. Biotechnol. 74:5-13 (2000). Relevant techniques for generating aptamers may be found in U.S. Pat. No. 6,699,843, which is incorporated by reference in its entirety.

Conjugates

The present disclosure also provides conjugates comprising one or more of the antigen binding proteins of the present disclosure linked to a heterologous moiety. As used herein, the term "heterologous moiety" is synonymous with the term "conjugate moiety" and refers to any molecule (chemical or biochemical, naturally-occurring or non-coded) which is different from the antigen binding proteins described herein. Exemplary conjugate moieties that can be linked to any of the antigen binding proteins described herein include but are not limited to a heterologous peptide or polypeptide, a targeting agent, a diagnostic label such as a radioisotope, fluorophore or enzymatic label, a polymer including water soluble polymers, or other therapeutic or diagnostic agents. The conjugate in some embodiments comprises one or more of the antigen binding proteins described herein and one or more of: a peptide (which is distinct from the antigen binding proteins described herein), a polypeptide, a nucleic acid molecule, another antibody or fragment thereof, a polymer, a quantum dot, a small molecule, a toxin, a diagnostic agent, a carbohydrate, an amino acid.

In exemplary embodiments, the conjugate of the present disclosure comprises an antigen binding protein as described herein and a heterologous moiety which is a polypeptide (e.g., a polypeptide distinct from any of the antigen binding proteins described herein), and the conjugate is a fusion polypeptide or fusion protein or a chimeric protein or chimeric polypeptide. Additional descriptions of such conjugates are provided herein under "Fusion proteins".

In some embodiments, the heterologous moiety is attached via non-covalent or covalent bonding to the antigen binding protein of the present disclosure. In exemplary aspects, the linkage between the antigen binding protein and the heterologous moiety is achieved via covalent chemical bonds, e.g., peptide bonds, disulfide bonds, and the like, or via physical forces, such as electrostatic, hydrogen, ionic, van der Waals, or hydrophobic or hydrophilic interactions. A variety of non-covalent coupling systems may be used, including, e.g., biotin-avidin, ligand/receptor, enzyme/substrate, nucleic acid/nucleic acid binding protein, lipid/lipid binding protein, cellular adhesion molecule partners; or any binding partners or fragments thereof which have affinity for each other.

The antigen binding protein in exemplary embodiments is linked to a conjugate moiety via direct covalent linkage by reacting targeted amino acid residues of the antigen binding protein with an organic derivatizing agent that is capable of reacting with selected side chains or the N- or C-terminal residues of these targeted amino acids. Reactive groups on the antigen binding protein or conjugate moiety include, e.g., an aldehyde, amino, ester, thiol, α-haloacetyl, maleimido or hydrazino group. Derivatizing agents include, for example, maleimidobenzoyl sulfosuccinimide ester (conjugation through cysteine residues), N-hydroxysuccinimide (through lysine residues), glutaraldehyde, succinic anhydride or other agents known in the art. Alternatively, the conjugate moieties can be linked to the antigen binding protein indirectly through intermediate carriers, such as polysaccharide or polypeptide carriers. Examples of polysaccharide carriers include aminodextran. Examples of suitable polypeptide carriers include polylysine, polyglutamic acid, polyaspartic acid, co-polymers thereof, and mixed polymers of these amino acids and others, e.g., serines, to confer desirable solubility properties on the resultant loaded carrier.

Cysteinyl residues are most commonly reacted with α-haloacetates (and corresponding amines), such as chloroacetic acid, chloroacetamide to give carboxymethyl or carboxyamidomethyl derivatives. Cysteinyl residues also are derivatized by reaction with bromotrifluoroacetone, alpha-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0.

Lysinyl and amino-terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate, pyridoxal phosphate, pyridoxal, chloroborohydride, trinitrobenzenesulfonic acid, O-methylisourea, 2,4-pentanedione, and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form 0-acetyl tyrosyl species and 3-nitro derivatives, respectively.

Carboxyl side groups (aspartyl or glutamyl) are selectively modified by reaction with carbodiimides (R—N=C=N—R'), where R and R' are different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Other modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)), deamidation of asparagine or glutamine, acetylation of the N-terminal amine, and/or amidation or esterification of the C-terminal carboxylic acid group.

Another type of covalent modification involves chemically or enzymatically coupling glycosides to the antigen binding protein. Sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of tyrosine, or tryptophan, or (f) the amide group of glutamine. These methods are described in WO87/05330 published 11 Sep. 1987, and in Aplin and Wriston, CRC Crit. Rev. Biochem., pp. 259-306 (1981).

In exemplary aspects, the heterologous moiety is attached to the antigen binding protein of the present disclosure via a linker. In some aspects, the linker comprises a chain of atoms from 1 to about 60, or 1 to 30 atoms or longer, 2 to 5 atoms, 2 to 10 atoms, 5 to 10 atoms, or 10 to 20 atoms long. In some embodiments, the chain atoms are all carbon atoms. In some embodiments, the chain atoms in the backbone of the linker are selected from the group consisting of C, O, N, and S. Chain atoms and linkers may be selected according to their expected solubility (hydrophilicity) so as to provide a more soluble conjugate. In some embodiments, the linker provides a functional group that is subject to cleavage by an enzyme or other catalyst or hydrolytic conditions found in the target tissue or organ or cell. In some embodiments, the length of the linker is long enough to reduce the potential for steric hindrance. If the linker is a covalent bond or a peptidyl bond and the conjugate is a polypeptide, the entire conjugate can be a fusion protein. Such peptidyl linkers may be any length. Exemplary peptidyl linkers are from about 1 to 50 amino acids in length, 5 to 50, 3 to 5, 5 to 10, 5 to 15, or 10 to 30 amino acids in length, and are flexible or rigid. In exemplary aspects, the linker is a peptide comprising about 2 to about 20 amino acids. In exemplary aspects, the linker is a peptide comprising about 2 to about 15 amino acid, about 2 to about 10 amino acids, or about 2 to about 5 amino acids. Suitable peptide linkers are known in the art. See, e.g., Chen et al., Adv Drug Delivery Reviews 65(10): 1357-1369 (2013); Arai et al., Protein Eng Des Sel 14(8): 529-532 (2001); and Wriggers et al., Curr Trends in Peptide Science 80(6): 736-746 (2005). In exemplary aspects, the linker is a peptide comprising the amino acid sequence GGGGS (SEQ ID NO: 2021).

Fusion Proteins

In exemplary embodiments, the antigen binding protein is linked to a polypeptide which is distinct from any of the antigen binding proteins described herein, and the conjugate is a fusion polypeptide or fusion protein or a chimeric protein or chimeric polypeptide. Accordingly, the present disclosure provides fusion polypeptides or fusion proteins comprising an antigen binding protein of the present disclosure and a heterologous polypeptide or peptide. In exemplary aspects, the fusion protein of the present disclosure comprises a HC variable amino acid sequence fused to a LC variable amino acid sequence or a FL HC sequence fused to a FL LC sequence. In various aspects, the fusion protein comprises a peptide linker between the HC variable amino acid sequence and the LC variable amino acid sequence or between the FL HC sequence and the FL LC sequence Nucleic Acids The present disclosure further provides nucleic acids comprising a nucleotide sequence encoding an antigen binding protein or polypeptide or fusion protein of the present disclosure. By "nucleic acid" as used herein includes "polynucleotide," "oligonucleotide," and "nucleic acid molecule," and generally means a polymer of DNA or RNA, or modified forms thereof, which can be single-stranded or double-stranded, synthesized or obtained (e.g., isolated and/or purified) from natural sources, which can contain natural, non-natural or altered nucleotides, and which can contain a natural, non-natural or altered inter-nucleotide linkage, such as a phosphoroamidate linkage or a phosphorothioate linkage, instead of the phosphodiester found between the nucleotides of an unmodified oligonucleotide. The nucleic acid can comprise any nucleotide sequence which encodes any of the antigen-binding proteins or polypeptides of the present disclosure. In some embodiments, the nucleic acid does not comprise any insertions, deletions, inversions, and/or substitutions. In other embodiments, the nucleic acid comprises one or more insertions, deletions, inversions, and/or substitutions.

In some aspects, the nucleic acids of the present disclosure are recombinant. As used herein, the term "recombinant" refers to (i) molecules that are constructed outside living cells by joining natural or synthetic nucleic acid segments to nucleic acid molecules that can replicate in a living cell, or (ii) molecules that result from the replication of those described in (i) above. For purposes herein, the replication can be in vitro replication or in vivo replication.

The nucleic acids in some aspects are constructed based on chemical synthesis and/or enzymatic ligation reactions using procedures known in the art. See, for example, Sambrook et al., supra; and Ausubel et al., supra. For example, a nucleic acid can be chemically synthesized using naturally occurring nucleotides or variously modified nucleotides designed to increase the biological stability of the molecules or to increase the physical stability of the duplex formed upon hybridization (e.g., phosphorothioate derivatives and acridine substituted nucleotides). Examples of modified nucleotides that can be used to generate the nucleic acids include, but are not limited to, 5-fluorouracil, 5-bromouracil, 5-chlorouracil, 5-iodouracil, hypoxanthine, xanthine, 4-acetylcytosine, 5-(carboxyhydroxymethyl) uracil, 5-carboxymethylaminomethyl-2-thiouridme, 5-carboxymethylaminomethyluracil, dihydrouracil, beta-D-galactosylqueosine, inosine, $N^6$-isopentenyladenine, 1-methylguanine, 1-methylinosine, 2,2-dimethylguanine, 2-methyladenine, 2-methylguanine, 3-methylcytosine, 5-methylcytosine, N-substituted adenine, 7-methylguanine, 5-methylammomethyluracil, 5-methoxyaminomethyl-2-thiouracil, beta-D-mannosylqueosine, 5'-methoxycarboxymethyluracil, 5-methoxyuracil, 2-methylthio-$N^6$-isopentenyladenine, uracil-5-oxyacetic acid (v), wybutoxosine, pseudouratil, queosine, 2-thiocytosine, 5-methyl-2-thiouracil, 2-thiouracil, 4-thiouracil, 5-methyluracil, uracil-5-oxyacetic acid methylester, 3-(3-amino-3-N-2-carboxypropyl) uracil, and 2,6-diaminopurine. Alternatively, one or more of the nucleic acids of the present disclosure can be purchased from companies, such as Macromolecular Resources (Fort Collins, CO) and Synthegen (Houston, TX).

In various aspects, the nucleic acid comprises a nucleotide sequence encoding an antigen binding protein or polypeptide or fusion protein of the present disclosure. In various aspects, the nucleic acid comprises a nucleotide sequence encoding an amino acid sequence(s) having a SEQ ID NO: listed in Table A1 or Table A2 or Table B1 or Table B2 or Table C1 or Table C2. In various aspects, the nucleotide sequence encodes an amino acid sequence comprising six of the CDRs of Table A1 or Table A2 with intervening amino acids. In various aspects, the nucleotide sequence only one of the HC variable or LC variable amino acid sequences of Table B1 or Table B2. In various aspects, nucleotide sequence encodes both the HC variable and LC variable amino acid sequences of Table B1 or Table B2 fused as one sequence, optionally, wherein the HC variable and LC variable amino acid sequences are linked together by a linker sequence. In various instances, the nucleotide sequence encodes a polypeptide described herein. In various aspects, the nucleotide sequence encodes only one of the FL HC or FL LC amino acid sequences of Table B1 or Table B2 or Table C1 or Table C2. In various aspects, nucleotide sequence encodes an amino acid sequence both the FL HC and FL LC amino acid sequences of Table B1 or Table B2 or Table C1 or Table C2 fused as one sequence, optionally, wherein the FL HC and FL LC are linked together by a linker sequence. In exemplary aspects, the nucleotide sequence encodes a variant sequence of a parent sequence comprising the amino acid sequence of Table A1 or Table A2 or Table B1 or Table B2 or Table C1 or Table C2. In various aspects, the nucleotide sequence encodes an amino acid sequence which differs by only 1, 2, 3, 4, 5, 6, or more amino acids, relative to the parent sequence. In exemplary aspects, the nucleotide sequence encodes a variant sequence which differs by only one or two amino acids, relative to the parent sequence. In exemplary aspects, the nucleotide sequence encodes a variant sequence having only 1, 2, 3, 4, 5, 6, or more conservative amino acid substitutions, relative to the above-referenced amino acid sequence(s). In exemplary aspects, the nucleic acid comprises a nucleotide sequence of any one of SEQ ID NOs: 2037-2092, as shown in Table D. In various instances, the nucleotide sequence of any one of SEQ ID NOs: 2037-2092 comprises a nucleotide sequence encoding a signal sequence. In various aspects, the nucleic acid of the present disclosure comprises a nucleotide sequence of any one of SEQ ID NOs: 2037-2092 without a nucleotide sequence encoding the signal sequence. In various aspects, the nucleic acid comprises a nucleotide sequence of any one of SEQ ID NOs: 2037-2092 without the first 60, 63, 66, or 69 nucleic acids of any one of SEQ ID NOs: 2037-2092.

TABLE D

| Ab Name | LC VARIABLE region | HC VARIABLE region |
|---|---|---|
| 1E1 | 2037 | 2038 |
| 1E1.016 | 2039 | 2040 |
| 24F1 | 2041 | 2042 |
| 29E10 | 2043 | 2044 |
| 24F1.001 | 2045 | 2046 |
| 29E10_CONS.020 | 2047 | 2048 |
| 29E10_CONS.021 | 2049 | 2050 |
| 29E10_CONS.022 | 2051 | 2052 |
| 29E10_CONS.025 | 2053 | 2054 |
| 11E4 | 2055 | 2056 |
| 31B3 | 2057 | 2058 |
| 27G12 | 2059 | 2060 |
| 28F9 | 2061 | 2062 |
| 28H7 | 2063 | 2064 |
| 36C8 | 2065 | 2066 |
| 55G7.041.008 | 2067 | 2068 |
| 58A7.003.008.075 | 2069 | 2070 |
| 4G10 | 2071 | 2072 |
| 11A3 | 2073 | 2074 |
| 28B8 | 2075 | 2076 |
| 39D2 | 2077 | 2078 |
| 43B7 | 2079 | 2080 |
| 55G7 | 2081 | 2082 |
| 66H9 | 2083 | 2084 |
| 43B7.002.015 | 2085 | 2086 |
| 58A7.003.008 | 2087 | 2088 |
| 66H9.009 | 2089 | 2090 |
| 58A7 | 2091 | 2092 |

Vectors

The nucleic acids of the present disclosure in some aspects are incorporated into a vector. In this regard, the present disclosure provides vectors comprising any of the presently disclosed nucleic acids. In exemplary aspects, the vector is a recombinant expression vector. For purposes herein, the term "recombinant expression vector" means a genetically-modified oligonucleotide or polynucleotide construct that permits the expression of an mRNA, protein, polypeptide, or peptide by a host cell, when the construct comprises a nucleotide sequence encoding the mRNA, protein, polypeptide, or peptide, and the vector is contacted with the cell under conditions sufficient to have the mRNA, protein, polypeptide, or peptide expressed within the cell. The vectors of the present disclosure are not naturally-occurring as a whole. However, parts of the vectors can be naturally-occurring. The presently disclosed vectors can comprise any type of nucleotides, including, but not limited to DNA and RNA, which can be single-stranded or double-stranded, synthesized or obtained in part from natural sources, and which can contain natural, non-natural or altered nucleotides. The vectors can comprise naturally-occurring or non-naturally-occurring internucleotide linkages, or both types of linkages. In some aspects, the altered nucleotides or non-naturally occurring internucleotide linkages do not hinder the transcription or replication of the vector.

The vector of the present disclosure can be any suitable vector and can be used to transform or transfect any suitable host. Suitable vectors include those designed for propagation and expansion or for expression or both, such as plasmids and viruses. The vector can be selected from the group consisting of the pUC series (Fermentas Life Sciences), the pBluescript series (Stratagene, LaJolla, CA), the pET series (Novagen, Madison, WI), the pGEX series (Pharmacia Biotech, Uppsala, Sweden), and the pEX series (Clontech, Palo Alto, CA). Bacteriophage vectors, such as λGTIO, λGTI1, λZapII (Stratagene), λEMBL4, and λNMI 149, also can be used. Examples of plant expression vectors include pBI01, pBI101.2, pBI101.3, pBI121 and pBIN19 (Clontech). Examples of animal expression vectors include pEUK-C1, pMAM and pMAMneo (Clontech). In some aspects, the vector is a viral vector, e.g., a retroviral vector.

The vectors of the present disclosure can be prepared using standard recombinant DNA techniques described in, for example, Sambrook et al., supra, and Ausubel et al., supra. Constructs of expression vectors, which are circular or linear, can be prepared to contain a replication system functional in a prokaryotic or eukaryotic host cell. Replication systems can be derived, e.g., from CoIE1, 2μ plasmid, SV40, bovine papilloma virus, and the like.

In some aspects, the vector comprises regulatory sequences, such as transcription and translation initiation and termination codons, which are specific to the type of host (e.g., bacterium, fungus, plant, or animal) into which the vector is to be introduced, as appropriate and taking into consideration whether the vector is DNA- or RNA-based.

The vector can include one or more marker genes, which allow for selection of transformed or transfected hosts. Marker genes include biocide resistance, e.g., resistance to antibiotics, heavy metals, etc., complementation in an auxotrophic host to provide prototrophy, and the like. Suitable marker genes for the presently disclosed expression vectors include, for instance, neomycin/G418 resistance genes, hygromycin resistance genes, histidinol resistance genes, tetracycline resistance genes, and ampicillin resistance genes.

The vector can comprise a native or normative promoter operably linked to the nucleotide sequence encoding the polypeptide (including functional portions and functional variants thereof), or to the nucleotide sequence which is complementary to or which hybridizes to the nucleotide sequence encoding the antigen binding protein. The selection of promoters, e.g., strong, weak, inducible, tissue-specific and developmental-specific, is within the ordinary skill of the artisan. Similarly, the combining of a nucleotide sequence with a promoter is also within the skill of the artisan. The promoter can be a non-viral promoter or a viral promoter, e.g., a cytomegalovirus (CMV) promoter, an SV40 promoter, an RSV promoter, and a promoter found in the long-terminal repeat of the murine stem cell virus.

In some embodiments, the vector encodes an antibody light chain, an antibody heavy chain, or an antibody light chain and heavy chain. A vector encoding an antibody light chain may be useful for producing an antibody of the present invention when expressed in a cell that further contains a vector encoding an antibody heavy chain. Likewise, a vector encoding an antibody heavy chain may be useful for producing an antibody of the present invention when expressed in a cell that further contains a vector encoding an antibody light chain. Thus, whereas both the light chain and the heavy chain may be encoded on a single vector, in certain embodiments the vector encodes the light chain but does not encode the heavy chain. In other embodiment, the vector encodes the heavy chain but does not encode the light chain.

In various aspects, the vector of the present comprises a nucleotide sequence encoding HC variable region or a full-length HC and a nucleotide sequence encoding LC variable region or a full-length LC. In alternative aspects, the vector of the present disclosure comprises a nucleotide sequence encoding HC variable region or a full-length HC as described in Table B1, C1, B2 or C2 or a nucleotide sequence encoding LC variable region or a full-length LC as described in Table B1, C1, B2 or C2.

Host Cells

Provided herein are host cells comprising one or more nucleic acids or vectors of the present disclosure. As used herein, the term "host cell" refers to any type of cell that can contain the presently disclosed vector or vectors and is capable of producing an expression product encoded by the nucleic acid(s) (e.g., mRNA, protein). The host cell in some aspects is an adherent cell or a suspended cell, i.e., a cell that grows in suspension. The host cell in exemplary aspects is a cultured cell or a primary cell, i.e., isolated directly from an organism. The host cell can be of any cell type, can originate from any type of tissue, and can be of any developmental stage.

In exemplary aspects, the cell is a eukaryotic cell, including, but not limited to, a yeast cell, filamentous fungi cell, protozoa cell, algae cell, insect cell, or mammalian cell. Such host cells are described in the art. See, e.g., Frenzel, et al., *Front Immunol* 4: 217 (2013). In exemplary aspects, the eukaryotic cells are mammalian cells. In exemplary aspects, the mammalian cells are non-human mammalian cells. In some aspects, the cells are Chinese Hamster Ovary (CHO) cells and derivatives thereof (e.g., CHO-K1, CHO pro-3, CS9), mouse myeloma cells (e.g., NS0, GS-NS0, Sp2/0), cells engineered to be deficient in dihydrofolatereductase (DHFR) activity (e.g., DUKX-X11, DG44), human embryonic kidney 293 (HEK293) cells or derivatives thereof (e.g., HEK293T, HEK293-EBNA), green African monkey kidney cells (e.g., COS cells, VERO cells), human cervical cancer cells (e.g., HeLa), human bone osteosarcoma epithelial cells U2-OS, adenocarcinomic human alveolar basal epithelial cells A549, human fibrosarcoma cells HT1080, mouse brain tumor cells CAD, embryonic carcinoma cells P19, mouse embryo fibroblast cells NIH 3T3, mouse fibroblast cells L929, mouse neuroblastoma cells N2a, human breast cancer cells MCF-7, retinoblastoma cells Y79, human retinoblastoma cells SO-Rb50, human liver cancer cells Hep G2, mouse B myeloma cells J558L, or baby hamster kidney (BHK) cells (Gaillet et al. 2007; Khan, Adv Pharm Bull 3(2): 257-263 (2013)). In a particular embodiment, the host cell is CS9 (a CHO cell line).

For purposes of amplifying or replicating the vector, the host cell is in some aspects a prokaryotic cell, e.g., a bacterial cell.

Also provided by the present disclosure is a population of cells comprising at least one host cell described herein. The population of cells in some aspects is a heterogeneous population comprising the host cell comprising vectors described, in addition to at least one other cell, which does not comprise any of the vectors. Alternatively, in some aspects, the population of cells is a substantially homogeneous population, in which the population comprises mainly host cells (e.g., consisting essentially of) comprising the vector. The population in some aspects is a clonal population of cells, in which all cells of the population are clones of a single host cell comprising a vector, such that all cells of the population comprise the vector. In exemplary embodiments of the present disclosure, the population of cells is a clonal population comprising host cells comprising a vector as described herein.

In various aspects of the present disclosure, the host cells comprise a first vector comprising a nucleotide sequence encoding HC variable region or a full-length HC as described in Table B1, C1, B2 or C2 and a second vector comprising a nucleotide sequence encoding LC variable region or a full-length LC as described in Table B1, C1, B2 or C2.

Pharmaceutical Compositions

Compositions comprising an antigen-binding protein (e.g., a TIGIT binding protein, a CD112R binding protein), a polypeptide, a nucleic acid, a vector, a host cell, a conjugate, a fusion protein of the present disclosure, or a combination thereof, are provided herein. The compositions in some aspects comprise the antigen-binding protein, polypeptide, a conjugate, fusion protein, nucleic acid, vector, or host cell of the present disclosure, or a combination thereof, in isolated and/or purified form. In some aspects, the composition comprises a single type (e.g., structure) of binding protein, polypeptide, a conjugate, fusion protein, nucleic acid, vector, or host cell of the present disclosure, or comprises a combination of two or more different types (e.g., different structures) of antigen-binding protein, polypeptide, conjugate, fusion protein, nucleic acid, vector or host cell of the present disclosure.

In exemplary aspects, the composition comprises agents which enhance the chemico-physico features of the antigen-binding protein, polypeptide, conjugate, fusion protein, nucleic acid, vector, or host cell, e.g., via stabilizing, for example, at certain temperatures (e.g., room temperature), increasing shelf life, reducing degradation, e.g., oxidation protease mediated degradation, increasing half-life of the antigen binding protein, etc. In some aspects, the composition comprises any of the agents disclosed herein as a heterologous moiety or conjugate moiety, optionally, in admixture with the antigen binding protein or polypeptide of the present disclosure.

In exemplary aspects of the present disclosure, the composition additionally comprises a pharmaceutically acceptable carrier, diluents, or excipient. In some embodiments, the antigen binding proteins, polypeptides, conjugates, fusion proteins, nucleic acids, vectors, or host cells as presently disclosed (hereinafter referred to as "active agents") are formulated into a pharmaceutical composition comprising the active agent, along with a pharmaceutically acceptable carrier, diluent, or excipient. In this regard, the present disclosure further provides pharmaceutical compositions comprising an active agent which pharmaceutical composition is intended for administration to a subject, e.g., a mammal.

In some embodiments, the active agent is present in the pharmaceutical composition at a purity level suitable for administration to a patient. In some embodiments, the active agent has a purity level of at least about 90%, about 91%, about 92%, about 93%, about 94%, about 95%, about 96%, about 97%, about 98% or about 99%, and a pharmaceutically acceptable diluent, carrier or excipient. In some embodiments, the compositions contain an active agent at a concentration of about 0.001 to about 30.0 mg/ml.

In exemplary aspects, the pharmaceutical compositions comprise a pharmaceutically acceptable carrier. As used herein, the term "pharmaceutically acceptable carrier" includes any of the standard pharmaceutical carriers, such as a phosphate buffered saline solution, water, emulsions such as an oil/water or water/oil emulsion, and various types of wetting agents. The term also encompasses any of the agents approved by a regulatory agency of the US Federal government or listed in the US Pharmacopeia for use in animals, including humans.

The pharmaceutical composition can comprise any pharmaceutically acceptable ingredients, including, for example, acidifying agents, additives, adsorbents, aerosol propellants, air displacement agents, alkalizing agents, anticaking agents, anticoagulants, antimicrobial preservatives, antioxidants, antiseptics, bases, binders, buffering agents, chelating agents, coating agents, coloring agents, desiccants, detergents, diluents, disinfectants, disintegrants, dispersing agents, dissolution enhancing agents, dyes, emollients, emulsifying agents, emulsion stabilizers, fillers, film forming agents, flavor enhancers, flavoring agents, flow enhancers, gelling agents, granulating agents, humectants, lubricants, mucoadhesives, ointment bases, ointments, oleaginous vehicles, organic bases, pastille bases, pigments, plasticizers, polishing agents, preservatives, sequestering agents, skin penetrants, solubilizing agents, solvents, stabilizing agents, suppository bases, surface active agents, surfactants, suspending agents, sweetening agents, therapeutic agents, thickening agents, tonicity agents, toxicity agents, viscosity-increasing agents, water-absorbing agents, water-miscible cosolvents, water softeners, or wetting agents. See, e.g., the *Handbook of Pharmaceutical Excipients*, Third Edition, A. H. Kibbe (Pharmaceutical Press, London, UK, 2000), which is incorporated by reference in its entirety. *Remington's Pharmaceutical Sciences*, Sixteenth Edition, E. W. Martin (Mack Publishing Co., Easton, Pa., 1980), which is incorporated by reference in its entirety.

In exemplary aspects, the pharmaceutical composition comprises formulation materials that are nontoxic to recipients at the dosages and concentrations employed. In specific embodiments, pharmaceutical compositions comprising an active agent and one or more pharmaceutically acceptable salts; polyols; surfactants; osmotic balancing agents; tonicity agents; anti-oxidants; antibiotics; antimycotics; bulking agents; lyoprotectants; anti-foaming agents; chelating agents; preservatives; colorants; analgesics; or additional pharmaceutical agents. In exemplary aspects, the pharmaceutical composition comprises one or more polyols and/or one or more surfactants, optionally, in addition to one or more excipients, including but not limited to, pharmaceutically acceptable salts; osmotic balancing agents (tonicity agents); anti-oxidants; antibiotics; antimycotics; bulking agents; lyoprotectants; anti-foaming agents; chelating agents; preservatives; colorants; and analgesics.

In certain embodiments, the pharmaceutical composition can contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate, triton, tromethamine, lecithin, cholesterol, tyloxapol); stability enhancing agents; tonicity enhancing agents (such as alkali metal halides, preferably sodium or potassium chloride, mannitol sorbitol); delivery vehicles; diluents; excipients and/or pharmaceutical adjuvants. See, REMINGTON'S PHARMACEUTICAL SCIENCES, 18" Edition, (A. R. Genrmo, ed.), 1990, Mack Publishing Company.

The pharmaceutical compositions can be formulated to achieve a physiologically compatible pH. In some embodiments, the pH of the pharmaceutical composition can be for example between about 4 or about 5 and about 8.0 or about 4.5 and about 7.5 or about 5.0 to about 7.5.

Routes of Administration

With regard to the present disclosure, the active agent, or pharmaceutical composition comprising the same, can be administered to the subject via any suitable route of administration. For example, the active agent can be administered to a subject via parenteral, nasal, oral, pulmonary, topical, vaginal, or rectal administration. The following discussion on routes of administration is merely provided to illustrate exemplary embodiments and should not be construed as limiting the scope in any way.

Formulations suitable for parenteral administration include aqueous and non-aqueous, isotonic sterile injection solutions, which can contain anti-oxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. The term, "parenteral" means not through the alimentary canal but by some other route such as subcutaneous, intramuscular, intraspinal, or intravenous. The active agent of the present disclosure can be administered with a physiologically acceptable diluent in a pharmaceutical carrier, such as a sterile liquid or mixture of liquids, including water, saline, aqueous dextrose and related sugar solutions, an alcohol, such as ethanol or hexadecyl alcohol, a glycol, such as propylene glycol or polyethylene glycol, dimethylsulfoxide, glycerol, ketals such as 2,2-dimethyl-153-dioxolane-4-methanol, ethers, poly(ethyleneglycol) 400, oils, fatty acids, fatty acid esters or glycerides, or acetylated fatty acid glycerides with or without the addition of a pharmaceutically acceptable surfactant, such as a soap or a detergent, suspending agent, such as pectin, carbomers, methylcellulose, hydroxypropylmethylcellulose, or carboxymethylcellulose, or emulsifying agents and other pharmaceutical adjuvants.

Oils, which can be used in parenteral formulations include petroleum, animal, vegetable, or synthetic oils. Specific examples of oils include peanut, soybean, sesame, cottonseed, corn, olive, petrolatum, and mineral. Suitable fatty acids for use in parenteral formulations include oleic acid, stearic acid, and isostearic acid. Ethyl oleate and isopropyl myristate are examples of suitable fatty acid esters.

Suitable soaps for use in parenteral formulations include fatty alkali metal, ammonium, and triethanolamine salts, and suitable detergents include (a) cationic detergents such as, for example, dimethyl dialkyl ammonium halides, and alkyl pyridinium halides, (b) anionic detergents such as, for example, alkyl, aryl, and olefin sulfonates, alkyl, olefin, ether, and monoglyceride sulfates, and sulfosuccinates, (c) nonionic detergents such as, for example, fatty amine oxides, fatty acid alkanolamides, and polyoxyethylenepolypropylene copolymers, (d) amphoteric detergents such as, for example, alkyl-β-aminopropionates, and 2-alkyl-imidazoline quaternary ammonium salts, and (e) mixtures thereof.

The parenteral formulations in some embodiments contain from about 0.5% to about 25% by weight of the active agent of the present disclosure in solution. Preservatives and buffers can be used. In order to minimize or eliminate irritation at the site of injection, such compositions can contain one or more nonionic surfactants having a hydrophile-lipophile balance (HLB) of from about 12 to about 17. The quantity of surfactant in such formulations will typically range from about 5% to about 15% by weight. Suitable surfactants include polyethylene glycol sorbitan fatty acid esters, such as sorbitan monooleate and the high molecular weight adducts of ethylene oxide with a hydrophobic base, formed by the condensation of propylene oxide with propylene glycol. The parenteral formulations in some aspects are presented in unit-dose or multi-dose sealed containers, such as ampoules and vials, and can be stored in a freeze-dried (lyophilized) condition requiring only the addition of the sterile liquid excipient, for example, water, for injections, immediately prior to use. Extemporaneous injection solutions and suspensions in some aspects are prepared from sterile powders, granules, and tablets of the kind previously described.

Injectable formulations are in accordance with the present disclosure. The requirements for effective pharmaceutical carriers for injectable compositions are well-known to those of ordinary skill in the art (see, e.g., *Pharmaceutics and Pharmacy Practice*, J. B. Lippincott Company, Philadelphia, PA, Banker and Chalmers, eds., pages 238-250 (1982), and *ASHP Handbook on Injectable Drugs*, Toissel, 4th ed., pages 622-630 (1986)).

Dosages

The active agents of the disclosure are believed to be useful in methods of inhibiting the biological activities that are initiated upon binding of TIGIT to CD155 or CD112R to CD112, as described herein, and are thus believed to be useful in methods of increasing an immune response, e.g., a T-cell mediated immune response and methods of treating or preventing one or more diseases, e.g., cancer. For purposes of the disclosure, the amount or dose of the active agent administered should be sufficient to effect, e.g., a therapeutic or prophylactic response, in the subject or animal over a reasonable time frame. For example, the dose of the active agent of the present disclosure should be sufficient to treat cancer as described herein in a period of from about 1 to 4 hours, 1 to 4 days, or 1 to 4 weeks or longer, e.g., 5 to 20 or more weeks, from the time of administration. In certain embodiments, the time period could be even longer. The dose will be determined by the efficacy of the particular active agent and the condition of the animal (e.g., human), as well as the body weight of the animal (e.g., human) to be treated.

Many assays for determining an administered dose are known in the art. For purposes herein, an assay, which comprises comparing the extent to which cancer is treated upon administration of a given dose of the active agent of the present disclosure to a mammal among a set of mammals, each set of which is given a different dose of the active agent, could be used to determine a starting dose to be administered to a mammal. The extent to which cancer is treated upon administration of a certain dose can be represented by, for example, the cytotoxicity of the active agent or the extent of tumor regression achieved with the active agent in a mouse xenograft model. Methods of measuring cytotoxicity of the antigen binding proteins and methods of assaying tumor regression are known in the art. Briefly, for assaying in vivo tumor regression, tumor xenografts may be established by subcutaneous inoculation of mice in the right flank with human tumor cells suspended in PBS pH 7.4. Tumors may be measured using a digital caliper. The tumor volume V (in mm$^3$) may be calculated using the formula V=($\pi$/6)LS$^2$ where L is the largest and S is the smallest superficial diameter. See, e.g., Shi et al., ACS Nano 9(4): 3740-3752 (2015).

The dose of the active agent of the present disclosure also will be determined by the existence, nature and extent of any adverse side effects that might accompany the administration of a particular active agent of the present disclosure. Typically, the attending physician will decide the dosage of the active agent of the present disclosure with which to treat each individual patient, taking into consideration a variety of factors, such as age, body weight, general health, diet, sex, active agent of the present disclosure to be administered, route of administration, and the severity of the condition being treated. By way of example and not intending to limit the present disclosure, the dose of the active agent of the present disclosure can be about 0.0001 to about 1 g/kg body weight of the subject being treated/day, from about 0.0001 to about 0.001 g/kg body weight/day, or about 0.01 mg to about 1 g/kg body weight/day.

Controlled Release Formulations

In some embodiments, the active agents described herein can be modified into a depot form, such that the manner in which the active agent of the present disclosure is released into the body to which it is administered is controlled with respect to time and location within the body (see, for example, U.S. Pat. No. 4,450,150). Depot forms of active agents of the present disclosure can be, for example, an implantable composition comprising the active agents and a porous or non-porous material, such as a polymer, wherein the active agent is encapsulated by or diffused throughout the material and/or degradation of the non-porous material. The depot is then implanted into the desired location within the body of the subject and the active agent is released from the implant at a predetermined rate.

The pharmaceutical composition comprising the active agent in certain aspects is modified to have any type of in vivo release profile. In some aspects, the pharmaceutical composition is an immediate release, controlled release, sustained release, extended release, delayed release, or biphasic release formulation. Methods of formulating peptides for controlled release are known in the art. See, for example, Qian et al., J Pharm 374: 46-52 (2009) and International Patent Application Publication Nos. WO 2008/130158, WO2004/033036; WO2000/032218; and WO 1999/040942.

The instant compositions can further comprise, for example, micelles or liposomes, or some other encapsulated form, or can be administered in an extended release form to provide a prolonged storage and/or delivery effect.

Combinations

In some embodiments, the active agents described herein are administered alone, and in alternative embodiments, are administered in combination with another therapeutic agent, e.g., another active agent of the present disclosure of a different type (e.g., structure). Accordingly, the present disclosure provides a combination comprising a first antigen binding protein which targets CD112R and a second antigen binding protein which targets TIGIT, each of which is an antigen binding protein according to the present disclosures. In various aspects, the first antigen binding protein is any one of 1E1, 1E1.016, 24F1, 29E10, 24F1.001, 29E10_CONS.020, 29E10_CONS.021, 29E10_CONS.022, 29E10_CONS.025, 11E4, 31B3, 27G12, 28F9, 28H7, or 36C8 as described in Table A1 or Table B1. In various aspects, the second antigen binding protein is any one of 55G7.041.008, 58A7.003.008.075, 4G10, 11A3, 28B8, 39D2, 43B7, 55G7, 66H9, 43B7.002.015, 58A7.003.08, 66H9.009, or 58A7 as described in Table A2 or Table B2. In various instances, the first antigen binding protein is 24F1, 29E10_CONS.020 or 29E10_CONS.022. In exemplary aspects, the second antigen binding protein is 43B7.002.015 or 66H9.009. In one aspect, the combination comprises 24F1 and 43B7.002.015. In another aspect, the combination comprises 24F1 and 66H9.009. In one aspect, the combination comprises 29E10_CONS.020 and 43B7.002.015. In another aspect, the combination comprises 29E10_CONS.020 and 66H9.009. In one aspect, the combination comprises 29E10_CONS.022 and 43B7.002.015. In another aspect, the combination comprises 29E10_CONS.022 and 66H9.009. In another aspect, the combination comprises 43B7.002.015 and 1E1.016 or 24F1 or 29E10. In yet another aspect, the combination comprises 66H9.009 and 1E1.016 or 24F1 or 29E10. In exemplary aspects, the combination comprises 43B7 and 29E10 or 24F1 or 11E4.

The present disclosure provides the combination as a composition, e.g., pharmaceutical composition, in various instances. Accordingly, the present disclosure provides a composition, e.g., pharmaceutical composition, comprising the first antigen binding protein and the second antigen binding protein. In various instances, the first antigen binding protein is 24F1, 29E10_CONS.020 or 29E10_CONS.022. In exemplary aspects, the second antigen binding protein is 43B7.002.015 or 66H9.009. In one aspect, the composition comprises 24F1 and 43B7.002.015. In another aspect, the composition comprises 24F1 and 66H9.009. In one aspect, the composition comprises 29E10_CONS.020 and 43B7.002.015. In another aspect, the composition comprises 29E10_CONS.020 and 66H9.009. In one aspect, the composition comprises 29E10_CONS.022 and 43B7.002.015. In another aspect, the composition comprises 29E10_CONS.022 and 66H9.009. In another aspect, the composition comprises 43B7.002.015 and 1E1.016 or 24F1 or 29E10. In yet another aspect, the composition comprises 66H9.009 and 1E1.016 or 24F1 or 29E10. In exemplary aspects, the composition comprises 43B7 and 29E10 or 24F1 or 11E4. In exemplary instances, the first antigen binding protein and the second antigen binding protein are present in the composition at a ratio of about 1:1.

In some aspects, the combination or composition further comprises an additional active agent, e.g., a third antigen binding protein. Optionally, the third antigen binding protein binds to a negative regulator of the immune system, an immune suppressor, or an immune checkpoint protein, including but not limited to CTLA-4, PD-1, PD-L1, PD-L2, B7-H3, B7-H4, CEACAM-1, TIGIT, LAG3, CD112, CD112R, CD96, TIM3, BTLA, or co-stimulatory receptor: ICOS, OX40, 41BB, CD27, GITR. In various instances, the additional active agent is a PD-1 binding protein, e.g., an anti-PD-1 antibody. Examples of anti-PD-1 antibodies include nivolumab (BMS-936558), pembrolizumab (MK3475), BMS 936558, BMS-936559, TSR-042 (Tesaro), ePDR001 (Novartis), and pidilizumab (CT-011). Optionally, the third antigen binding protein is any PD-1 antigen binding proteins described in International Patent Application No. PCT/US2019/013205, which published as WO/2019/140196 the entire contents of which is incorporated herein by reference. In exemplary instances, the third antigen binding protein comprises a HC CDR1 amino acid sequence, a HC CDR2 amino acid sequence, a HC CDR3 amino acid sequence, a LC CDR amino acid sequence, a LC CDR2 amino acid sequence, and a LC CDR3 amino acid sequence of SEQ ID NOs: 352-357 of WO/2019/140196, respectively. In exemplary instances, the third antigen binding protein comprises a HC CDR1 amino acid sequence, a HC CDR2 amino acid sequence, a HC CDR3 amino acid sequence, a LC CDR amino acid sequence, a LC CDR2 amino acid sequence, and a LC CDR3 amino acid sequence of SEQ ID NOs: 2027-2032, respectively. In various aspects, the third antigen binding protein comprises a HC variable region amino acid sequence and a LC variable region amino acid sequence of SEQ ID NO: 358 and SEQ ID NO: 359 of WO/2019/140196, respectively. In various aspects, the third antigen binding protein comprises a HC variable region amino acid sequence and a LC variable region amino acid sequence of SEQ ID NO: 2033 and SEQ ID NO: 2034, respectively. In various instances, the third antigen binding protein comprises a FL HC amino acid sequence and a FL LC amino acid sequence of SEQ ID NO: 360 and SEQ ID NO: 361 of WO/2019/140196, respectively. In various instances, the third antigen binding protein comprises a FL HC amino acid sequence and a FL LC amino acid sequence of SEQ ID NO: 2035 and SEQ ID NO: 2036, respectively. In various instances, the third antigen binding protein comprises a FL HC amino acid sequence and a FL LC amino acid sequence of SEQ ID NO: 2093 and SEQ ID NO: 2094, respectively. Optionally, the first antigen binding protein and the second antigen binding protein and the third antigen binding protein are present in the composition at a ratio of about 1:1:1.

In some aspects, the other therapeutic aims to treat or prevent cancer. In some embodiments, the other therapeutic is a chemotherapeutic agent. In some embodiments, the other therapeutic is an agent used in radiation therapy for the treatment of cancer. Accordingly, in some aspects, the active agents described herein are administered in combination with one or more of platinum coordination compounds, topoisomerase inhibitors, antibiotics, antimitotic alkaloids and difluoronucleosides.

Kits

The present disclosure additionally provides kits comprising an antigen-binding protein, polypeptide a conjugate, fusion protein, nucleic acid, vector, or host cell of the present disclosure, or a combination thereof. The kit in exemplary aspects comprises at least one antigen-binding protein, polypeptide a conjugate, fusion protein, nucleic acid, vector, or host cell of the present disclosure, or a combination thereof, in a container. In exemplary aspects, the at least one antigen-binding protein, polypeptide a conjugate, fusion protein, nucleic acid, vector, or host cell of the present disclosure, is provided in the kit as a unit dose. For purposes herein "unit dose" refers to a discrete amount dispersed in a suitable carrier. In exemplary aspects, the unit dose is the amount sufficient to provide a subject with a desired effect, e.g., treatment of cancer. In exemplary aspects, the kit comprises several unit doses, e.g., a week or month supply of unit doses, optionally, each of which is individually packaged or otherwise separated from other unit doses. In some embodiments, the components of the kit/unit dose are packaged with instructions for administration to a patient. In some embodiments, the kit comprises one or more devices for administration to a patient, e.g., a needle and syringe, and the like. In some aspects, the at least one antigen-binding protein, polypeptide a conjugate, fusion protein, nucleic acid, vector, or host cell of the present disclosure, or a combination thereof, is/are pre-packaged in a ready to use form, e.g., a syringe, an intravenous bag, etc. In exemplary aspects, the ready to use form is for a single use. In exemplary aspects, the kit comprises multiple single use, ready to use forms of the at least one antigen-binding protein, polypeptide a conjugate, fusion protein, nucleic acid, vector, or host cell of the present disclosure. In some aspects, the kit further comprises other therapeutic or diagnostic agents or pharmaceutically acceptable carriers (e.g., solvents, buffers, diluents, etc.), including any of those described herein.

In various aspects, the kit comprises more than one antigen binding protein of the present disclosure. In exemplary instances, the kit comprises a first antigen binding protein which binds to CD112R and a second antigen binding protein which binds to TIGIT. Optionally, the first antigen binding protein is formulated with the second antigen binding protein. In some aspects, the kit comprises a composition comprising the first antigen binding protein and the second antigen binding protein. In various aspects, the first antigen binding protein is packaged and/or formulated separately from the second antigen binding agent. In various instances, the first antigen binding protein is any one of 1E1, 1E1.016, 24F1, 29E10, 24F1.001, 29E10_CONS.020, 29E10_CONS.021, 29E10_CONS.022, 29E10_CONS.025, 11E4, 31B3, 27G12, 28F9, 28H7, or 36C8 as described in Table A1 or Table B1. In various aspects, the second antigen binding protein is any one of 55G7.041.008, 58A7.003.008.075, 4G10, 11A3, 28B8, 39D2, 43B7, 55G7, 66H9, 43B7.002.015, 58A7.003.08, 66H9.009, or 58A7 as described in Table A2 or Table B2. In various instances, the first antigen binding protein is 24F1, 29E10_CONS.020 or 29E10_CONS.022. In exemplary aspects, the second antigen binding protein is 43B7.002.015 or 66H9.009. In one aspect, the kit comprises 24F1 and 43B7.002.015. In another aspect, the kit comprises 24F1 and 66H9.009. In one aspect, the kit comprises 29E10_CONS.020 and 43B7.002.015. In another aspect, the kit comprises 29E10_CONS.020 and 66H9.009. In one aspect, the kit comprises 29E10_CONS.022 and 43B7.002.015. In another aspect, the kit comprises 29E10_CONS.022 and 66H9.009. In another aspect, the kit comprises 43B7.002.015 and 1E1.016 or 24F1 or 29E10. In yet another aspect, the kit comprises 66H9.009 and 1E1.016 or 24F1 or 29E10. In exemplary aspects, the kit comprises 43B7 and 29E10 or 24F1 or 11E4. In exemplary instances, the first antigen binding protein and the second antigen binding protein are present in the composition at a ratio of about 1:1.

In various instances, the kit comprises an additional active agent, e.g., a third antigen binding protein. Optionally, the third antigen binding protein binds to a negative regulator of the immune system, an immune suppressor, or an immune checkpoint protein, including but not limited to CTLA-4, PD-1, PD-L1, PD-L2, B7-H3, B7-H4, CEACAM-1, TIGIT, LAG3, CD112, CD112R, CD96, TIM3, BTLA, or co-stimulatory receptor: ICOS, OX40, 41BB, CD27, GITR. In various instances, the additional active agent is a PD-1 binding protein, e.g., an anti-PD-1 antibody. Examples of anti-PD-1 antibodies include nivolumab (BMS-936558), pembrolizumab (MK3475), BMS 936558, BMS-936559, TSR-042 (Tesaro), ePDR001 (Novartis), and pidilizumab (CT-011). Optionally, the third antigen binding protein is any PD-1 antigen binding proteins described in International Patent Application No. PCT/US2019/013205, which published as WO/2019/140196 the entire contents of which is incorporated herein by reference. In exemplary instances, the third antigen binding protein comprises a HC CDR1 amino acid sequence, a HC CDR2 amino acid sequence, a HC CDR3 amino acid sequence, a LC CDR amino acid sequence, a LC CDR2 amino acid sequence, and a LC CDR3 amino acid sequence of SEQ ID NOs: 352-357 of WO/2019/140196, respectively. In exemplary instances, the third antigen binding protein comprises a HC CDR1 amino acid sequence, a HC CDR2 amino acid sequence, a HC CDR3 amino acid sequence, a LC CDR amino acid sequence, a LC CDR2 amino acid sequence, and a LC CDR3 amino acid sequence of SEQ ID NOs: 2027-2032, respectively. In various aspects, the third antigen binding protein comprises a HC variable region amino acid sequence and a LC variable region amino acid sequence of SEQ ID NO: 358 and SEQ ID NO: 359 of WO/2019/140196, respectively. In various aspects, the third antigen binding protein comprises a HC variable region amino acid sequence and a LC variable region amino acid sequence of SEQ ID NO: 2033 and SEQ ID NO: 2034, respectively. In various instances, the third antigen binding protein comprises a FL HC amino acid sequence and a FL LC amino acid sequence of SEQ ID NO: 360 and SEQ ID NO: 361 of WO/2019/140196, respectively. In various instances, the third antigen binding protein comprises a FL HC amino acid sequence and a FL LC amino acid sequence of SEQ ID NO: 2035 and SEQ ID NO: 2036, respectively. In various aspects, each antigen binding protein is separately packaged in the kit. Optionally, the kit comprises a container, e.g., a vial, syringe, bag, etc. comprising at least two of the first, second, and third antigen binding proteins. Optionally, the kit comprises all the antigen binding proteins in the same container as an admixture.

Methods of Treatment

Methods of treatment are additionally provided by the present disclosure. The method, in exemplary embodiments, is a method of treating a subject in need thereof, comprising administering to the subject in need thereof a pharmaceutical composition of the present disclosure in an amount effective to treat the subject.

The pharmaceutical compositions of the present disclosure are useful for inhibiting TIGIT signaling and/or CD112R signaling and/or PD-1 signaling. Without being bound to a particular theory, the TIGIT inhibiting activity and/or CD112R inhibiting activity and/or PD-1 inhibiting activity of the compositions provided herein allow such entities to be useful in methods of enhancing T cell activity and enhancing an immune response, and, in particular, an immune response against a tumor or cancer.

Accordingly, provided herein are methods of enhancing T cell activity in a subject, enhancing T cell survival and effector function, restricting terminal differentiation and loss of replicative potential, promoting T cell longevity, and enhancing cytotoxicity against target (e.g., cancer) cells. In exemplary embodiments, the methods comprise administering to the subject the pharmaceutical composition of the present disclosure in an effective amount. In exemplary aspects, the T cell activity or immune response is directed against a cancer cell or cancer tissue or a tumor cell or tumor. In exemplary aspects, the immune response is a humoral immune response. In exemplary aspects, the immune response is an innate immune response. In exemplary aspects, the immune response which is enhanced is a T-cell mediated immune response.

As used herein, the term "enhance" and words stemming therefrom may not be a 100% or complete enhancement or increase. Rather, there are varying degrees of enhancement of which one of ordinary skill in the art recognizes as having a potential benefit or therapeutic effect. In this respect, the pharmaceutical compositions of the present disclosure may enhance, e.g., T cell activity or enhance an immune response, to any amount or level. In exemplary embodiments, the enhancement provided by the methods of the present disclosure is at least or about a 10% enhancement (e.g., at least or about a 20% enhancement, at least or about a 30% enhancement, at least or about a 40% enhancement, at least or about a 50% enhancement, at least or about a 60% enhancement, at least or about a 70% enhancement, at least or about a 80% enhancement, at least or about a 90% enhancement, at least or about a 95% enhancement, at least or about a 98% enhancement).

Methods of measuring T cell activity and immune responses are known in the art. T cell activity can be measured by, for example, a cytotoxicity assay, such as those described in Fu et al., PLoS ONE 5(7): e11867 (2010). Other T cell activity assays are described in Bercovici et al., Clin Diagn Lab Immunol. 7(6): 859-864 (2000). Methods of measuring immune responses are described in e.g., Macatangay et al., Clin Vaccine Immunol 17(9): 1452-1459 (2010), and Clay et al., Clin Cancer Res. 7(5):1127-35 (2001).

Also provided herein are methods of enhancing natural killer (NK) cell activity in a subject. In exemplary embodiments, the methods comprise administering to the subject the pharmaceutical composition of the present disclosure in an effective amount. In exemplary aspects, the NK cell activity is directed against a cancer cell or cancer tissue or a tumor cell or tumor.

Additionally provided herein are methods of treating a subject with cancer and methods of treating a subject with a solid tumor. In exemplary embodiments, the method comprises administering to the subject the pharmaceutical composition of the present disclosure in an amount effective for treating the cancer or the solid tumor in the subject. The cancer treatable by the methods disclosed herein can be any cancer, e.g., any malignant growth or tumor caused by abnormal and uncontrolled cell division that may spread to other parts of the body through the lymphatic system or the blood stream. The cancer in some aspects is one selected from the group consisting of acute lymphocytic cancer, acute myeloid leukemia, alveolar rhabdomyosarcoma, bone cancer, brain cancer, breast cancer, cancer of the anus, anal canal, or anorectum, cancer of the eye, cancer of the intrahepatic bile duct, cancer of the joints, cancer of the neck, gallbladder, or pleura, cancer of the nose, nasal cavity, or middle ear, cancer of the oral cavity, cancer of the vulva, chronic lymphocytic leukemia, chronic myeloid cancer, colon cancer, esophageal cancer, cervical cancer, gastrointestinal carcinoid tumor, Hodgkin lymphoma, hypopharynx cancer, kidney cancer, larynx cancer, liver cancer, lung cancer, malignant mesothelioma, melanoma, multiple myeloma, nasopharynx cancer, non-Hodgkin lymphoma, ovarian cancer, pancreatic cancer, peritoneum, omentum, and mesentery cancer, pharynx cancer, prostate cancer, rectal cancer, renal cancer (e.g., renal cell carcinoma (RCC)), small intestine cancer, soft tissue cancer, stomach cancer, testicular cancer, thyroid cancer, ureter cancer, and urinary bladder cancer. In particular aspects, the cancer is selected from the group consisting of: head and neck, ovarian, cervical, bladder and oesophageal cancers, pancreatic, gastrointestinal cancer, gastric, breast, endometrial and colorectal cancers, hepatocellular carcinoma, glioblastoma, bladder, lung cancer, e.g., non-small cell lung cancer (NSCLC), bronchioloalveolar carcinoma. In particular embodiments, the tumor is non-small cell lung cancer (NSCLC), head and neck cancer, renal cancer, triple negative breast cancer, and gastric cancer. In exemplary aspects, the subject has a tumor (e.g., a solid tumor, a hematological malignancy, or a lymphoid malignancy) and the pharmaceutical composition is administered to the subject in an amount effective to treat the tumor in the subject. In other exemplary aspects, the tumor is non-small cell lung cancer (NSCLC), small cell lung cancer (SCLC), head and neck cancer, renal cancer, breast cancer, melanoma, ovarian cancer, liver cancer, pancreatic cancer, colon cancer, prostate cancer, gastric cancer, lymphoma or leukemia, and the pharmaceutical composition is administered to the subject in an amount effective to treat the tumor in the subject.

As used herein, the term "treat," as well as words related thereto, do not necessarily imply 100% or complete treatment. Rather, there are varying degrees of treatment of which one of ordinary skill in the art recognizes as having a potential benefit or therapeutic effect. In this respect, the methods of treating cancer of the present disclosure can provide any amount or any level of treatment. Furthermore, the treatment provided by the method of the present disclosure can include treatment of one or more conditions or symptoms or signs of the cancer being treated. Also, the treatment provided by the methods of the present disclosure can encompass slowing the progression of the cancer. For example, the methods can treat cancer by virtue of enhancing the T cell activity or NK cell activity or an immune response against the cancer, reducing tumor or cancer growth, reducing metastasis of tumor cells, increasing cell death of tumor or cancer cells, and the like. In exemplary aspects, the methods treat by way of delaying the onset or recurrence of the cancer by 1 day, 2 days, 4 days, 6 days, 8 days, 10 days, 15 days, 30 days, two months, 4 months, 6 months, 1 year, 2 years, 4 years, or more. In exemplary aspects, the methods treat by way increasing the survival of the subject.

Subjects

In some embodiments of the present disclosure, the subject is a mammal, including, but not limited to, mammals of the order Rodentia, such as mice and hamsters, and mammals of the order Logomorpha, such as rabbits, mammals from the order Carnivora, including Felines (cats) and Canines (dogs), mammals from the order Artiodactyla, including Bovines (cows) and Swines (pigs) or of the order Perssodactyla, including Equines (horses). In some aspects, the mammals are of the order Primates, Ceboids, or Simoids (monkeys) or of the order Anthropoids (humans and apes). In some aspects, the mammal is a human.

Methods of Manufacture

The antigen binding proteins of the present disclosure may be obtained by methods known in the art. Suitable methods of de novo synthesizing polypeptides are described in, for example, Chan et al., Fmoc Solid Phase Peptide Synthesis, Oxford University Press, Oxford, United Kingdom, 2005; Peptide and Protein Drug Analysis, ed. Reid, R., Marcel Dekker, Inc., 2000; Epitope Mapping, ed. Westwood et al., Oxford University Press, Oxford, United Kingdom, 2000; and U.S. Pat. No. 5,449,752. Additional exemplary methods of making the peptides of the invention are set forth herein.

In some embodiments, the antigen binding proteins described herein are commercially synthesized by companies, such as Synpep (Dublin, CA), Peptide Technologies Corp. (Gaithersburg, MD), Multiple Peptide Systems (San Diego, CA), Peptide 2.0 Inc. (Chantilly, VA), and American Peptide Co. (Sunnyvale, CA). In this respect, the antigen binding proteins can be synthetic, recombinant, isolated, and/or purified.

Also, in some aspects, the antigen binding proteins are recombinantly produced using a nucleic acid encoding the amino acid sequence of the peptide using standard recombinant methods. See, for instance, Sambrook et al., Molecular Cloning: A Laboratory Manual. 3rd ed., Cold Spring Harbor Press, Cold Spring Harbor, NY 2001; and Ausubel et al., Current Protocols in Molecular Biology, Greene Publishing Associates and John Wiley & Sons, N Y, 1994.

Methods of making the presently disclosed antigen-binding proteins are further provided herein. In exemplary embodiments, the method comprises culturing a presently disclosed host cell so as to express the antigen-binding protein and harvesting the expressed antigen-binding protein. The host cell can be any of the host cells described herein. In exemplary aspects, the host cell is selected from the group consisting of: CHO cells, NS0 cells, COS cells, VERO cells, and BHK cells. In exemplary aspects, the step of culturing a host cell comprises culturing the host cell in a growth medium to support the growth and expansion of the host cell. In exemplary aspects, the growth medium increases cell density, culture viability and productivity in a timely manner. In exemplary aspects, the growth medium comprises amino acids, vitamins, inorganic salts, glucose, and serum as a source of growth factors, hormones, and attachment factors. In exemplary aspects, the growth medium is a fully chemically defined media consisting of amino acids, vitamins, trace elements, inorganic salts, lipids and insulin or insulin-like growth factors. In addition to nutrients, the growth medium also helps maintain pH and osmolality. Several growth media are commercially available and are described in the art. See, e.g., Arora, "Cell Culture Media: A Review" MATER METHODS 3:175 (2013).

In exemplary aspects, the method of making an antigen binding protein of the present disclosure comprises culturing the host cell in a feed medium. In exemplary aspects, the method comprises culturing in a feed medium in a fed-batch mode. Methods of recombinant protein production are known in the art. See, e.g., Li et al., "Cell culture processes for monoclonal antibody production" MAbs 2(5): 466-477 (2010).

The method making an antigen binding protein can comprise one or more steps for purifying the protein from a cell culture or the supernatant thereof and preferably recovering the purified protein. In exemplary aspects, the method comprises one or more chromatography steps, e.g., affinity chromatography (e.g., protein A affinity chromatography), ion exchange chromatography, hydrophobic interaction chromatography. In exemplary aspects, the method comprises purifying the protein using a Protein A affinity chromatography resin.

In exemplary embodiments, the method further comprises steps for formulating the purified protein, etc., thereby obtaining a formulation comprising the purified protein. Such steps are described in Formulation and Process Development Strategies for Manufacturing, eds. Jameel and Hershenson, John Wiley & Sons, Inc. (Hoboken, NJ), 2010.

EXEMPLARY EMBODIMENTS

The following is a listing of exemplary embodiments of the present disclosure:
1. A CD112R antigen-binding protein, optionally, an antibody or antigen-binding fragment thereof, comprising (a) a heavy chain (HC) complementarity-determining region (CDR) 1 amino acid sequence set forth in Table A1 or a variant sequence thereof which differs by only 1-4 amino acids or which has at least or about 90% sequence identity; (b) an HC CDR2 amino acid sequence set forth in Table A1 or a variant sequence thereof which differs by only 1-4 amino acids or which has at least or about 90% sequence identity; (c) an HC CDR3 amino acid sequence set forth in Table A1 or a variant sequence thereof which differs by only 1-4 amino acids or which has at least or about 90% sequence identity; (d) a light chain (LC) CDR1 amino acid sequence set forth in Table A1 or a variant sequence thereof which differs by only 1-4 amino acids or which has at least or about 90% sequence identity; (e) an LC CDR2 amino acid sequence set forth in Table A1 or a variant sequence thereof which differs by only 1-4 amino acids or which has at least or about 90% sequence identity; (f) an LC CDR3 amino acid sequence set forth in Table A1 or a variant sequence thereof which differs by only 1-4 amino acids or which has at least or about 90% sequence identity; or (g) a combination of any two or more of (a)-(f).

2. The CD112R antigen-binding protein of embodiment 1, comprising six CDR amino acid sequences listed in a single row of Table A1 or comprising six CDR amino acid sequences selected from the group consisting of: (a) SEQ ID NOs: 13-18; (b) SEQ ID NOs: 23-28; (c) SEQ ID NOs: 33-38; (d) SEQ ID NOs: 43-48; (e) SEQ ID NOs: 53-58; (f) SEQ ID NOs: 63-68; (g) SEQ ID NOs: 73-78; (h) SEQ ID NOs: 83-88, (i) SEQ ID NOs: 93-98, (j) SEQ ID NOs: 103-108, (k) SEQ ID NOs: 233-238, (l) SEQ ID NOs: 1973-1978, (m) SEQ ID NOs: 1983-1988, (n) SEQ ID NOs: 1993-1998, and (o) SEQ ID NOs: 2003-2008.

3. The CD112R antigen binding protein of embodiment 1 or 2, comprising (a) a HC variable region amino acid sequence set forth in Table B1 or a variant sequence thereof which differs by only 1-15 amino acids or which has at least or about 90% or about 95% sequence identity to the HC variable region amino acid sequence of Table B1; (b) a LC variable region amino acid sequence set forth in Table B1 or a variant sequence thereof which differs by only 1-15 amino acids or which has at least or about 90% or about 95% sequence identity to the LC variable region amino acid sequence of Table B1, or (c) a combination of (a) and (b).

4. The CD112R antigen-binding protein of embodiment 3, comprising a pair of HC variable region and LC variable region amino acid sequences listed in a single row of Table B1 or comprising a pair of amino acid sequences selected from the group consisting of: (a) SEQ ID NOs: 11-12; (b) SEQ ID NOs: 21-22; (c) SEQ ID NOs: 31-32; (d) SEQ ID NOs: 41-42; (e) SEQ ID NOs: 51-52; (f) SEQ ID NOs: 61-62; (g) SEQ ID NOs: 71-72; (h) SEQ ID NOs: 81-82, (i) SEQ ID NOs: 91-92, (j) SEQ ID NOs: 101-102, (k) SEQ ID NOs: 231-232, (l) SEQ ID NOs: 1971-1972, (m) SEQ ID NOs: 1981-1982, (n) SEQ ID NOs: 1991-1992, and (o) SEQ ID NOs: 2001-2002.

5. The CD112R antigen binding protein of any one of the preceding embodiments, comprising (a) a full-length (FL) HC amino acid sequence set forth in Table B1 or a variant sequence thereof which differs by only 1-50 amino acids or which has at least or about 90% or about 95% sequence identity to the FL HC amino acid sequence of Table B1; (b) a FL LC amino acid sequence set forth in Table B1 or a variant sequence thereof which differs by only 1-50 amino acids or which has at least or about 90% or about 95% sequence identity to the FL LC amino acid sequence of Table B1, or (c) a combination of (a) and (b).

6. The CD112R antigen-binding protein of embodiment 5, comprising a pair of full-length (FL) HC and FL LC amino acid sequences listed in a single row of Table B or comprising a pair of amino acid sequences selected from the group consisting of: (a) SEQ ID NOs: 9-10; (b) SEQ ID NOs: 19-20; (c) SEQ ID NOs: 29-30; (d) SEQ ID NOs: 39-40; (e) SEQ ID NOs: 49-50; (f) SEQ ID NOs: 59-60; (g) SEQ ID NOs: 69-70; (h) SEQ ID NOs: 79-80, (i) SEQ ID NOs: 89-90, (j) SEQ ID NOs: 99-100, (k) SEQ ID NOs: 229-230, (l) SEQ ID NOs: 1969-1970, (m) SEQ ID NOs: 1979-1980, (n) SEQ ID NOs: 1989-1990, and (o) SEQ ID NOs: 1999-2000.

7. The CD112R antigen-binding protein of any one of the preceding embodiments, which is an antibody.

8. The CD112R antigen-binding protein of claim 7, comprising:
(a) a heavy chain (HC) complementarity-determining region (CDR) 1 amino acid sequence of SEQ ID NO: 33 or a variant sequence thereof which differs by only 1-4 amino acids or which has at least or about 90% sequence identity; (b) an HC CDR2 amino acid sequence of SEQ ID NO: 34 or a variant sequence thereof which differs by only 1-4 amino acids or which has at least or about 90% sequence identity; (c) an HC CDR3 amino acid sequence of SEQ ID NO: 35 or a variant sequence thereof which differs by only 1-4 amino acids or which has at least or about 90% sequence identity; (d) a light chain (LC) CDR1 amino acid sequence of SEQ ID NO: 36 or a variant sequence thereof which differs by only 1-4 amino acids or which has at least or about 90% sequence identity; (e) an LC CDR2 amino acid sequence of SEQ ID NO: 37 or a variant sequence thereof which differs by only 1-4 amino acids or which has at least or about 90% sequence identity; (f) an LC CDR3 amino acid sequence of SEQ ID NO: 38 or a variant sequence thereof which differs by only 1-4 amino acids or which has at least or about 90% sequence identity; or
(b) a heavy chain (HC) complementarity-determining region (CDR) 1 amino acid sequence of SEQ ID NO: 63 or a variant sequence thereof which differs by only 1-4 amino acids or which has at least or about 90% sequence identity; (b) an HC CDR2 amino acid sequence of SEQ ID NO: 64 or a variant sequence thereof which differs by only 1-4 amino acids or which has at least or about 90% sequence identity; (c) an HC CDR3 amino acid sequence of SEQ ID NO: 65 or a variant sequence thereof which differs by only 1-4 amino acids or which has at least or about 90% sequence identity; (d) a light chain (LC) CDR1 amino acid sequence of SEQ ID NO: 66 or a variant sequence thereof which differs by only 1-4 amino acids or which has at least or about 90% sequence identity; (e) an LC CDR2 amino acid sequence of SEQ ID NO: 67 or a variant sequence thereof which differs by only 1-4 amino acids or which has at least or about 90% sequence identity; (f) an LC CDR3 amino acid sequence of SEQ ID NO: 68 or a variant sequence thereof which differs by only 1-4 amino acids or which has at least or about 90% sequence identity; or
(c) a heavy chain (HC) complementarity-determining region (CDR) 1 amino acid sequence of SEQ ID NO: 83 or a variant sequence thereof which differs by only 1-4 amino acids or which has at least or about 90% sequence identity; (b) an HC CDR2 amino acid sequence of SEQ ID NO: 84 or a variant sequence thereof which differs by only 1-4 amino acids or which has at least or about 90% sequence identity; (c) an HC CDR3 amino acid sequence of SEQ ID NO: 85 or a variant sequence thereof which differs by only 1-4 amino acids or which has at least or about 90% sequence identity; (d) a light chain (LC) CDR1 amino acid sequence of SEQ ID NO: 86 or a variant sequence thereof which differs by only 1-4 amino acids or which has at least or about 90% sequence identity; (e) an LC CDR2 amino acid sequence of SEQ ID NO: 87 or a variant sequence thereof which differs by only 1-4 amino acids or which has at least or about 90% sequence identity; (f) an LC CDR3 amino acid sequence of SEQ ID NO: 88 or a variant sequence thereof which differs by only 1-4 amino acids or which has at least or about 90% sequence identity; or (d) comprising (a) a HC variable region amino acid sequence of SEQ ID NO:31 or a variant sequence thereof which differs by only 1-15 amino acids or which has at least or about 90% or about 95% sequence identity to the HC variable region amino acid sequence of SEQ ID NO: 31; (b) a LC variable region amino acid sequence of SEQ ID NO: 32 or a variant sequence thereof which differs by only 1-15 amino acids or which has at least or about 90% or about 95% sequence identity to the LC variable region amino acid sequence of SEQ ID NO: 32, or (c) a combination of (a) and (b); or (e) comprising (a) a HC variable region amino acid sequence of SEQ ID NO: 61 or a variant sequence thereof which differs by only 1-15 amino acids or which has at least or about 90% or about 95% sequence identity to the HC variable region amino acid sequence of SEQ ID NO: 61; (b) a LC variable region amino acid sequence of SEQ ID NO: 62 or a variant sequence thereof which differs by only 1-15 amino acids or which has at least or about 90% or about 95% sequence identity to the LC variable region amino acid sequence of SEQ ID NO: 62, or (c) a combination of (a) and (b); or (f) comprising (a) a HC variable region amino acid sequence of SEQ ID NO: 81 or a variant sequence thereof which differs by only 1-15 amino acids or which has at least or about 90% or about 95% sequence identity to the HC variable region amino acid sequence of SEQ ID NO: 81; (b) a LC variable region amino acid sequence of SEQ ID NO: 82 or a variant sequence thereof which differs by only 1-15 amino acids or which has at least or about 90% or about 95% sequence identity to the LC variable region amino acid sequence of SEQ ID NO: 82, or (c) a combination of (a) and (b); or (g) (a) a full-length (FL) HC amino acid sequence of SEQ ID NO: 29 or a variant sequence thereof which differs by only 1-50 amino acids or which has at least or about 90% or about 95% sequence identity to the FL HC amino acid sequence of SEQ ID NO: 29; (b) a FL LC amino acid sequence set forth of SEQ ID NO: 30 or a variant sequence thereof which differs by only 1-50 amino acids or which has at least or about 90% or about 95% sequence identity to the FL LC amino acid sequence of SEQ ID NO: 30, or (c) a combination of (a) and (b); or (h) (a) a full-length (FL) HC amino acid sequence of SEQ ID NO: 59 or a variant sequence thereof which differs by only 1-50 amino acids or which has at least or about 90% or about 95% sequence identity to the FL HC amino acid sequence of SEQ ID NO: 59; (b) a FL LC amino acid sequence set forth of SEQ ID NO: 60 or a variant sequence thereof which differs by only 1-50 amino acids or which has at least or about 90% or about 95% sequence identity to the FL LC amino acid sequence of SEQ ID NO: 60, or (c) a combination of (a) and (b); or (i) (a) a full-length (FL) HC amino acid sequence of SEQ ID NO: 79 or a variant sequence thereof which differs by only 1-50 amino acids or which has at least or about 90% or about 95% sequence identity to the FL HC amino acid sequence of SEQ ID NO: 79; (b) a FL LC amino acid sequence set forth of SEQ ID NO: 80 or a variant sequence thereof which differs by only 1-50 amino acids or which has at least or about 90% or about 95% sequence identity to the FL LC amino acid sequence of SEQ ID NO: 80, or (c) a combination of (a) and (b).

9. The CD112R antigen-binding protein of any one of the preceding embodiments, which is an antigen-binding fragment of an antibody.

10. The CD112R antigen-binding protein of any one of the preceding embodiments, which is an antibody protein product, optionally, an scFv.

11. A polypeptide comprising an amino acid sequence of a SEQ ID NO: of Table A1, B1, or C1, or a variant sequence thereof which has at least or about 90% or about 95% sequence identity to the amino acid sequence of the SEQ ID NO: of the Table, or a combination thereof 12. A conjugate comprising a CD112R antigen binding protein or polypeptide of any one of the preceding embodiments and a heterologous moiety.

13. The conjugate of embodiment 12, comprising an amino acid sequence of the antigen binding protein or polypeptide fused to another amino acid sequence.

14. A nucleic acid encoding the CD112R antigen binding protein or polypeptide or conjugate of any one of the preceding embodiments.

15. A nucleic acid encoding a light chain, a heavy chain, or both a light chain and a heavy chain of the antibody of embodiment 9 or 10.

16. The nucleic acid of embodiment 14 or 15, wherein the nucleotide sequence encodes (a) a HC variable region amino acid sequence set forth in Table B1 or a variant sequence thereof which differs by only 1-15 amino acids or which has at least or about 90% or about 95% sequence identity to the HC variable region amino acid sequence of Table B1; (b) a LC variable region amino acid sequence set forth in Table B1 or a variant sequence thereof which differs by only 1-15 amino acids or which has at least or about 90% or about 95% sequence identity to the LC variable region amino acid sequence of Table B1, or (c) both (a) and (b).

17. A vector comprising one or more nucleic acids of any one of embodiments 14-16.

18. A host cell comprising one or more nucleic acids of any one of embodiments 14-16 or one or more vectors of embodiment 17.

19. The host cell of embodiment 18, wherein the host cell produces a CD112R antigen binding protein of any of embodiments 1-10.

20. A TIGIT antigen-binding protein optionally, an antibody or antigen-binding fragment thereof, comprising (a) a heavy chain (HC) complementarity-determining region (CDR) 1 amino acid sequence set forth in Table A2 or a variant sequence thereof which differs by only 1-4 amino acids or which has at least or about 90% sequence identity; (b) an HC CDR2 amino acid sequence set forth in Table A2 or a variant sequence thereof which differs by only 1-4 amino acids or which has at least or about 90% sequence identity; (c) an HC CDR3 amino acid sequence set forth in Table A2 or a variant sequence thereof which differs by only 1-4 amino acids or which has at least or about 90% sequence identity; (d) a light chain (LC) CDR1 amino acid sequence set forth in Table A2 or a variant sequence thereof which differs by only 1-4 amino acids or which has at least or about 90% sequence identity; (e) an LC CDR2 amino acid sequence set forth in Table A2 or a variant sequence thereof which differs by only 1-4 amino acids or which has at least or about 90% sequence identity; (f) an LC CDR3 amino acid sequence set forth in Table A2 or a variant sequence thereof which differs by only 1-4 amino acids or which has at least or about 90% sequence identity; or (g) a combination of any two or more of (a)-(f).

21. The TIGIT antigen binding protein of embodiment 20, comprising:
    a. a LC CDR1 amino acid sequence comprising Gln27, or a conservative amino acid substitution thereof, Ser28, or a conservative amino acid substitution thereof, or any combination thereof; a LC CDR2 amino acid sequence comprising Glu1, or a conservative amino acid substitution thereof; and a LC CDR3 amino acid sequence comprising Ser91, or a conservative amino acid substitution thereof, Ser92, or a conservative amino acid substitution thereof, Ser93, or a conservative amino acid substitution thereof, Leu94, or a conservative amino acid substitution thereof, or any combination thereof; a HC CDR1 amino acid sequence comprising Val32, or a conservative amino acid substitution thereof, Tyr33, or a conservative amino acid substitution thereof, or any combination thereof; a HC CDR2 amino acid sequence comprising Tyr52, or a conservative amino acid substitution thereof, Tyr54, or a conservative amino acid substitution thereof, Tyr55, or a conservative amino acid substitution thereof, Ser56, or a conservative amino acid substitution thereof, Gly57, or a conservative amino acid substitution thereof, Gly58, or a conservative amino acid substitution thereof, Thr59, or a conservative amino acid substitution thereof, Tyr60, or a conservative amino acid substitution thereof, Pro63, or a conservative amino acid substitution thereof, Arg66, or a conservative amino acid substitution thereof, or any combination thereof; and a HC CDR3 amino acid sequence comprising Ile102, or a conservative amino acid substitution thereof, Ala104, or a conservative amino acid substitution thereof, Gly107, or a conservative amino acid substitution thereof, Tyr108, or a conservative amino acid substitution thereof, Phe109, or a conservative amino acid substitution thereof, Tyr110, or a conservative amino acid substitution thereof, Tyr111, or a conservative amino acid substitution thereof, or any combination thereof; wherein the position number is relative the LC variable region amino acid sequence of the TIGIT antigen binding protein
    b. a LC CDR1 amino acid sequence comprising Gln27, or a conservative amino acid substitution thereof, Ser28, or a conservative amino acid substitution thereof, Val29, or a conservative amino acid substitution thereof, Ser30, or a conservative amino acid substitution thereof, Ser31, or a conservative amino acid substitution thereof, Thr32, or a conservative amino acid substitution thereof, Tyr33, or a conservative amino acid substitution thereof, or any combination thereof; a LC CDR2 amino acid sequence comprising Glu1, or a conservative amino acid substitution thereof, Ile2, or a conservative amino acid substitution thereof, Ser68, or a conservative amino acid substitution thereof, Gly69, or a conservative amino acid substitution thereof, or any combination thereof; a LC CDR3 amino acid sequence comprising Tyr92, or a conservative amino acid substitution thereof, Asp93, or a conservative amino acid substitution thereof, Val94, or a conservative amino acid substitution thereof, Ser95, or a conservative amino acid substitution thereof, Pro96, or a conservative amino acid substitution thereof, Trp97, or a conservative amino acid substitution thereof, or any combination thereof; a HC CDR1 amino acid sequence comprising Gly32, or a conservative amino acid substitution thereof, Tyr35, or a conservative amino acid substitution thereof, or any combination thereof; a HC CDR2 amino acid sequence comprising Tyr52, or a conservative amino acid substitution thereof, Tyr54, or a conservative amino acid substitution thereof, Tyr55, or a conservative amino acid substitution thereof, Ser56, or a conservative amino acid substitution thereof, Ser58, or a conservative amino acid substitution thereof, Thr59, or a conservative amino acid substitution thereof, Phe60, or a conservative amino acid substitution thereof, Pro63, or a conservative amino acid substitution thereof, Lys66, or a conservative amino acid substitution thereof, or any combination thereof; a HC CDR3 amino acid sequence comprising Arg102, or a conservative amino acid substitution thereof, Asn104, or a conservative amino acid substitution thereof, Trp105, or a conservative amino acid substitution thereof, Asn106, or a conservative amino acid substitution thereof, Tyr107, or a conservative amino acid substitution thereof, or any combination thereof; wherein the position number is relative the LC variable region amino acid sequence of the TIGIT antigen binding protein
    c. a LC CDR1 amino acid sequence comprising Arg30, or a conservative amino acid substitution thereof, Arg31, or a conservative amino acid substitution thereof, Tyr32, or a conservative amino acid substitution thereof, or any combination thereof; a LC CDR3 amino acid sequence comprising Ser91, or a conservative amino acid substitution thereof, Tyr92, or a conservative amino acid substitution thereof, Ser93, or a conservative amino acid substitution thereof, Thr94, or a conservative amino acid substitution thereof, or any combination thereof, wherein the position number is relative the LC variable region amino acid sequence of the TIGIT antigen binding protein; a HC CDR1 amino acid sequence comprising Thr30, or a conservative amino acid substitution thereof, Gly31 or a conservative amino acid substitution thereof, Tyr32, or a conservative amino acid substitution thereof, Tyr33, or a conservative amino acid substitution thereof, or any combination thereof; a HC CDR2 amino acid sequence comprising Trp47, or a conservative amino acid substitution thereof, a Trp50, or a conservative amino acid substitution thereof, Ser52, or a conservative amino acid substitution thereof, Thr54, or a conservative amino acid substitution thereof, Ser55, or a conservative amino acid substitution thereof, Ala57, or a conservative amino acid substitution thereof, Thr58, or a conservative amino acid substitution thereof, Gly59, or a conservative amino acid substitution thereof, Tyr60, or a conservative amino acid substitution thereof, Gln65, or a conservative amino acid substitution thereof, or any combination thereof; a HC CDR3 amino acid sequence comprising Asn101, or a conservative amino acid substitution thereof, Ser102, or a conservative amino acid substitution thereof, Val103, or a conservative amino acid substitution thereof, Leu104, or a conservative amino acid substitution thereof, Tyr105, or a conservative amino acid substitution thereof, Tyr106, or a conservative amino acid substitution thereof, Tyr107, or a conservative amino acid substitution thereof, or any combination thereof; wherein the position number is relative the HC variable region amino acid sequence of the TIGIT antigen binding protein;

d. a LC CDR1 amino acid sequence comprising Gln27, or a conservative amino acid substitution thereof, Leu30, or a conservative amino acid substitution thereof, Ser32, or a conservative amino acid substitution thereof, or any combination thereof; a LC CDR3 amino acid sequence comprising Ser96, or a conservative amino acid substitution thereof, Ile97, or a conservative amino acid substitution thereof, Gln98, or a conservative amino acid substitution thereof, Leu99, or a conservative amino acid substitution thereof, or any combination thereof; a HC CDR1 amino acid sequence comprising Asp33, or a conservative amino acid substitution thereof; a HC CDR2 amino acid sequence comprising Tyr52, or a conservative amino acid substitution thereof, a Tyr54, or a conservative amino acid substitution thereof, Tyr55, or a conservative amino acid substitution thereof, Ser56, or a conservative amino acid substitution thereof, Gly57, or a conservative amino acid substitution thereof, Gly58, or a conservative amino acid substitution thereof, Thr59, or a conservative amino acid substitution thereof, Tyr60, or a conservative amino acid substitution thereof, Pro63, or a conservative amino acid substitution thereof, Lys66, or a conservative amino acid substitution thereof, or any combination thereof; a HC CDR3 amino acid sequence comprising Ile102, or a conservative amino acid substitution thereof, Ala104, or a conservative amino acid substitution thereof, Gly107, or a conservative amino acid substitution thereof, Tyr108, or a conservative amino acid substitution thereof, Phe109, or a conservative amino acid substitution thereof, Tyr110, or a conservative amino acid substitution thereof, Phe111, or a conservative amino acid substitution thereof, or any combination thereof; wherein the position number is relative the HC variable region amino acid sequence of the TIGIT antigen binding protein;

22. The TIGIT antigen-binding protein of embodiment 20 or 21, comprising six CDR amino acid sequences listed in a single row of Table A2 or comprising six CDR amino acid sequences selected from the group consisting of: (a) SEQ ID NOs: 113-118; (b) SEQ ID NOs: 123-128; (c) SEQ ID NOs: 133-138; (d) SEQ ID NOs: 143-148; (e) SEQ ID NOs: 153-158; (0 SEQ ID NOs: 163-168; (g) SEQ ID NOs: 173-178; (h) SEQ ID NOs: 183-188, (i) SEQ ID NOs: 193-198, (j) SEQ ID NOs: 203-208, (k) SEQ ID NOs: 213-218, (l) SEQ ID NOs: 223-228, and (m) SEQ ID NOs: 2013-2018.

23. The TIGIT antigen binding protein of any one of embodiments 20-22, comprising (a) a HC variable region amino acid sequence set forth in Table B2 or a variant sequence thereof which differs by only 1-15 amino acids or which has at least or about 90% or about 95% sequence identity to the HC variable region amino acid sequence of Table B2; (b) a LC variable region amino acid sequence set forth in Table B2 or a variant sequence thereof which differs by only 1-15 amino acids or which has at least or about 90% or about 95% sequence identity to the LC variable region amino acid sequence of Table B2, or (c) a combination of (a) and (b).

24. The TIGIT antigen-binding protein of embodiment 23, comprising a pair of HC variable region and LC variable region amino acid sequences listed in a single row of Table B2 or comprising a pair of amino acid sequences selected from the group consisting of: (a) SEQ ID NOs: 111-112, (b) SEQ ID NOs: 121-122, (c) SEQ ID NOs: 131-132, (d) SEQ ID NOs: 141-142, (e) SEQ ID NOs: 151-152, (f) SEQ ID NOs: 161-162, (g) SEQ ID NOs: 171-172, (h) SEQ ID NOs: 181-182, (i) SEQ ID NOs: 191-192, (j) SEQ ID NOs: 201-202, (k) SEQ ID NOs: 211-212, (l) SEQ ID NOs: 221-222, and (m) SEQ ID NOs: 2011-2012.

25. The TIGIT antigen binding protein of any one of embodiments 20-24, comprising (a) a full-length (FL) HC amino acid sequence set forth in Table B2 or a variant sequence thereof which differs by only 1-50 amino acids or which has at least or about 90% or about 95% sequence identity to the FL HC amino acid sequence of Table B2; (b) a FL LC amino acid sequence set forth in Table B2 or a variant sequence thereof which differs by only 1-50 amino acids or which has at least or about 90% or about 95% sequence identity to the FL LC amino acid sequence of Table B2, or (c) a combination of (a) and (b).

26. The TIGIT antigen-binding protein of embodiment 25, comprising a pair of full-length (FL) HC and FL LC amino acid sequences listed in a single row of Table B2 or comprising a pair of amino acid sequences selected from the group consisting of: (a) SEQ ID NOs: 109-110, (b) SEQ ID NOs: 119-120, (c) SEQ ID NOs: 129-130, (d) SEQ ID NOs: 139-140, (e) SEQ ID NOs: 149-150, (f) SEQ ID NOs: 159-160, (g) SEQ ID NOs: 169-170, (h) SEQ ID NOs: 179-180, (i) SEQ ID NOs: 189-190, (j) SEQ ID NOs: 199-200, (k) SEQ ID NOs: 209-210, (1) SEQ ID NOs: 219-220, and (m) SEQ ID NOs: 2009-2010.

27. The TIGIT antigen-binding protein of any one of embodiments 20-26, which is an antibody.

28. The TIGIT antigen-binding protein of embodiment 27, comprising:
(a) a heavy chain (HC) complementarity-determining region (CDR) 1 amino acid sequence of SEQ ID NO: 203 or a variant sequence thereof which differs by only 1-4 amino acids or which has at least or about 90% sequence identity; (b) an HC CDR2 amino acid sequence of SEQ ID NO: 204 or a variant sequence thereof which differs by only 1-4 amino acids or which has at least or about 90% sequence identity; (c) an HC CDR3 amino acid sequence of SEQ ID NO: 205 or a variant sequence thereof which differs by only 1-4 amino acids or which has at least or about 90% sequence identity; (d) a light chain (LC) CDR1 amino acid sequence of SEQ ID NO: 206 or a variant sequence thereof which differs by only 1-4 amino acids or which has at least or about 90% sequence identity; (e) an LC CDR2 amino acid sequence of SEQ ID NO: 207 or a variant sequence thereof which differs by only 1-4 amino acids or which has at least or about 90% sequence identity; (f) an LC CDR3 amino acid sequence of SEQ ID NO: 208 or a variant sequence thereof which differs by only 1-4 amino acids or which has at least or about 90% sequence identity; or (b) a heavy chain (HC) complementarity-determining region (CDR) 1 amino acid sequence of SEQ ID NO: 223 or a variant sequence thereof which differs by only 1-4 amino acids or which has at least or about 90% sequence identity; (b) an HC CDR2 amino acid sequence of SEQ ID NO: 224 or a variant sequence thereof which differs by only 1-4 amino acids or which has at least or about 90% sequence identity; (c) an HC CDR3 amino acid sequence of SEQ ID NO: 225 or a variant sequence thereof which differs by only 1-4 amino acids or which has at least or about 90% sequence identity; (d) a light chain (LC) CDR1 amino acid sequence of SEQ ID NO: 226 or a variant sequence thereof which differs by only 1-4 amino acids or which has at least or about 90% sequence identity; (e) an LC CDR2 amino acid sequence of SEQ ID NO: 227 or a variant sequence thereof which differs by only 1-4 amino acids or which has at least or about 90% sequence identity; (f) an LC CDR3 amino acid sequence of SEQ ID NO: 228 or a variant sequence thereof which differs by only 1-4 amino acids or which has at least or about 90% sequence identity; or (c) comprising (a) a HC variable region amino acid sequence of SEQ ID NO:201 or a variant sequence thereof which differs by only 1-15 amino acids or which has at least or about 90% or about 95% sequence identity to the HC variable region amino acid sequence of SEQ ID NO: 201; (b) a LC variable region amino acid sequence of SEQ ID NO: 202 or a variant sequence thereof which differs by only 1-15 amino acids or which has at least or about 90% or about 95% sequence identity to the LC variable region amino acid sequence of SEQ ID NO: 202, or (c) a combination of (a) and (b); or (d) comprising (a) a HC variable region amino acid sequence of SEQ ID NO: 221 or a variant sequence thereof which differs by only 1-15 amino acids or which has at least or about 90% or about 95% sequence identity to the HC variable region amino acid sequence of SEQ ID NO: 221; (b) a LC variable region amino acid sequence of SEQ ID NO: 222 or a variant sequence thereof which differs by only 1-15 amino acids or which has at least or about 90% or about 95% sequence identity to the LC variable region amino acid sequence of SEQ ID NO: 222, or (c) a combination of (a) and (b); or (e) (a) a full-length (FL) HC amino acid sequence of SEQ ID NO: 199 or a variant sequence thereof which differs by only 1-50 amino acids or which has at least or about 90% or about 95% sequence identity to the FL HC amino acid sequence of SEQ ID NO: 199; (b) a FL LC amino acid sequence set forth of SEQ ID NO: 200 or a variant sequence thereof which differs by only 1-50 amino acids or which has at least or about 90% or about 95% sequence identity to the FL LC amino acid sequence of SEQ ID NO: 200, or (c) a combination of (a) and (b); or (f) (a) a full-length (FL) HC amino acid sequence of SEQ ID NO: 219 or a variant sequence thereof which differs by only 1-50 amino acids or which has at least or about 90% or about 95% sequence identity to the FL HC amino acid sequence of SEQ ID NO: 219; (b) a FL LC amino acid sequence set forth of SEQ ID NO: 220 or a variant sequence thereof which differs by only 1-50 amino acids or which has at least or about 90% or about 95% sequence identity to the FL LC amino acid sequence of SEQ ID NO: 220, or (c) a combination of (a) and (b).

29. The TIGIT antigen-binding protein of any one of embodiments 20-26, which is an antigen-binding fragment of an antibody.

30. The TIGIT antigen-binding protein of any one of embodiments 20-26, which is an antibody protein product, optionally, an scFv.

31. A polypeptide comprising an amino acid sequence of a SEQ ID NO: of Table A2, B2, or C2, or a variant sequence thereof which has at least or about 90% or about 95% sequence identity to the amino acid sequence of the SEQ ID NO: of the Table, or a combination thereof 32. A conjugate comprising a TIGIT antigen binding protein or polypeptide of any one of the preceding embodiments and a heterologous moiety.

33. The conjugate of embodiment 32, comprising an amino acid sequence of the antigen binding protein or polypeptide fused to another amino acid sequence.

34. A nucleic acid encoding the TIGIT antigen binding protein or polypeptide or conjugate of any one of the preceding embodiments.

35. A nucleic acid encoding a light chain, a heavy chain, or both a light chain and a heavy chain of the antibody of embodiment 27 or 28.

36. The nucleic acid of embodiment 34 or 35, wherein the nucleotide sequence encodes (a) a HC variable region amino acid sequence set forth in Table B2 or a variant sequence thereof which differs by only 1-15 amino acids or which has at least or about 90% or about 95% sequence identity to the HC variable region amino acid sequence of Table B2; (b) a LC variable region amino acid sequence set forth in Table B2 or a variant sequence thereof which differs by only 1-15 amino acids or which has at least or about 90% or about 95% sequence identity to the LC variable region amino acid sequence of Table B2, or (c) both (a) and (b).

37. A vector comprising one or more nucleic acids of any one of embodiments 34 to 36.

38. A host cell comprising one or more nucleic acids of any one of embodiments 34 to 36 or one or more vectors of embodiment 37.

39. The host cell of embodiment 37, wherein the host cell produces a TIGIT antigen binding protein of any of embodiments 20-30.

40. A composition comprising a CD112R antigen binding protein of any one of embodiments 1-10 and a TIGIT antigen binding protein of any one of embodiments 20-30.

41. The composition of embodiment 40, wherein (A) the CD112R antigen binding protein is 1E1, 1E1.016, 24F1, 29E10, 24F1.001, 29E10_CONS.020, 29E10_CONS.021, 29E10_CONS.022, 29E10_CONS.025, 11E4, 31B3, 27G12, 28F9, 28H7, or 36C8 as described in Table A1 or Table B1, optionally, 24F1, 29E10_CONS.020 or 29E10_CONS.022, (B) the TIGIT antigen binding protein is any one of 55G7.041.008, 58A7.003.008.075, 4G10, 11A3, 28B8, 39D2, 43B7, 55G7, 66H9, 43B7.002.015, 58A7.003.08, 66H9.009, or 58A7 as described in Table A2 or Table B2, optionally, 43B7.002.015 or 66H9.009, or a combination of (A) and (B).

42. The composition of embodiment 40 or 41, comprising (A) 24F1 and 43B7.002.015, (B) 24F1 and 66H9.009, (C) 29E10_CONS.020 and 43B7.002.015, (D) 29E10_CONS.020 and 66H9.009, (E) 29E10_CONS.022 and 43B7.002.015, (F) 29E10_CONS.022 and 66H9.009, (G) 43B7.002.015 and 1E1.016, (H) 43B7.002.015 and 24F1, (I) 43B7.002.015 and 29E10, (J) 66H9.009 and 1E1.016, (K) 66H9.009 and 29E10, (L) 43B7 and 29E10, (M) 43B7 and 24F1, or (N) 43B7 and 11E4.

43. The composition of any one of claims 40-42, wherein the CD112R antigen binding protein and the TIGIT antigen binding protein is present in the composition at a ratio of about 1:1.

44. The composition of any one of embodiments 40-43, further comprising a third antigen binding protein which targets PD-1.

45. The composition of embodiment 44, wherein the third antigen binding protein is any PD-1 antigen binding proteins described in International Patent Application No. PCT/US2019/013205, which published as WO/2019/140196.

46. The composition of embodiment 44 or 45, wherein the third antigen binding protein comprises a HC variable region amino acid sequence of SEQ ID NO: 2033 and a LC variable region amino acid sequence of SEQ ID NO: 2034.

47. A kit comprising an antigen-binding protein of any one of embodiments 1-10, the polypeptide of embodiment 11, the conjugate of embodiment 12 or 13, the nucleic acid of any one of embodiments 14 to 16, the vector of embodiment 17, the host cell of embodiment 18 or 19, an antigen-binding protein of any one of embodiments 20-30, the polypeptide of embodiment 31, the conjugate of embodiment 32 or 33, the nucleic acid of embodiment 34 to 36, the vector of embodiment 37, the host cell of embodiment 38 or 39, a composition of any one of embodiments 40-46, or a combination thereof, and a container.

48. A pharmaceutical composition comprising an antigen-binding protein of any one of embodiments 1-10, the polypeptide of embodiment 11, the conjugate of embodiment 12 or 13, the nucleic acid of any one of embodiments 14 to 16, the vector of embodiment 17, the host cell of embodiment 18 or 19, an antigen-binding protein of any one of embodiments 20-30, the polypeptide of embodiment 31, the conjugate of embodiment 32 or 33, the nucleic acid of embodiment 34 to 36, the vector of embodiment 37, the host cell of embodiment 38 or 39, a composition of any one of embodiments 40-46, or a combination thereof, and a pharmaceutically acceptable carrier, excipient, or diluent.

49. A method of making CD112R antigen-binding protein comprising culturing the host cell of any one of embodiments 18 or 19 so as to express the CD112R antigen-binding protein and harvesting the expressed CD112R antigen-binding protein.

50. A method of making TIGIT antigen-binding protein comprising culturing the host cell of any one of embodiments 38 or 39 so as to express the TIGIT antigen-binding protein and harvesting the expressed TIGIT antigen-binding protein.

51. A method of treating a subject in need thereof, comprising administering to the subject in need thereof a pharmaceutical composition of embodiment 48 in an amount effective to treat the subject.

52. The method of embodiment 51, wherein the subject has a solid tumor and the pharmaceutical composition is administered to the subject in an amount effective to treat the solid tumor in the subject.

53. A method of treating a subject in need thereof, comprising administering to the subject in need thereof a first pharmaceutical composition comprising a CD112R antigen binding protein and a TIGIT antigen binding protein and a second pharmaceutical composition comprising PD-1 inhibitor.

54. The method of embodiment 53, wherein the subject has a solid tumor and the first pharmaceutical composition and second pharmaceutical composition are administered in amounts effective to treat the solid tumor in the subject.

The following examples are given merely to illustrate the present invention and not in any way to limit its scope.

EXAMPLES

Example 1

This example describes TIGIT family receptor and ligand expression in cancer and normal T cells.

Correlation analyses were performed with RNAseq data from The Cancer Genome Atlas (TCGA) on multiple tumor indications to assess co-expression of TIGIT family members with each other and with PD-1. The same analyses were performed for the ligands of the TIGIT family members and PD-1. The tumor indications included Breast Invasive Carcinoma (BRCA), Kidney Renal Clear Cell Carcinoma (KIRC), -Neck Squamous Cell Carcinoma (HNSC), and Skin Cutaneous Melanoma (SKCM).

Figures 1, 1A:
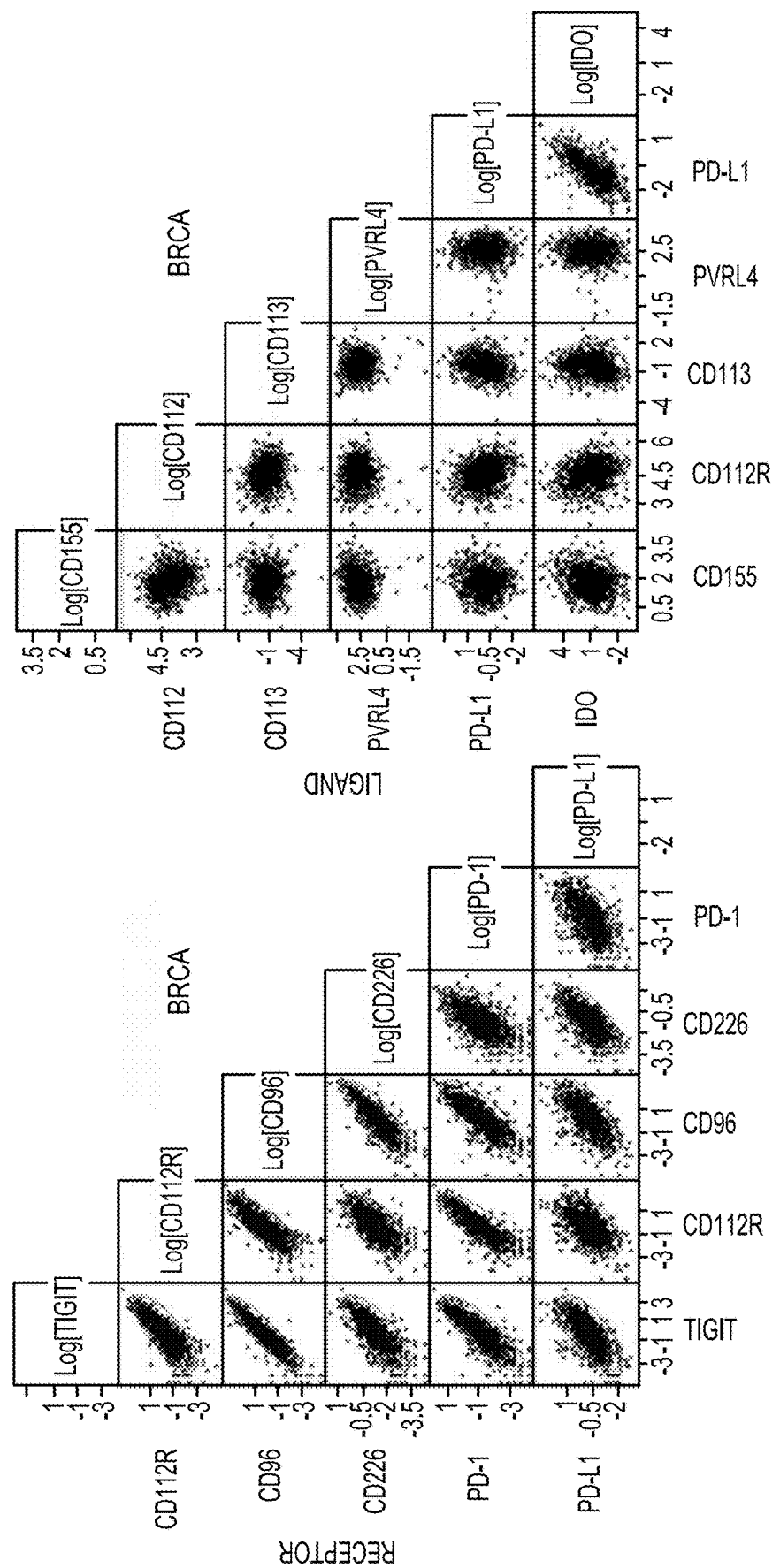
Figures 1, 1A, 2:
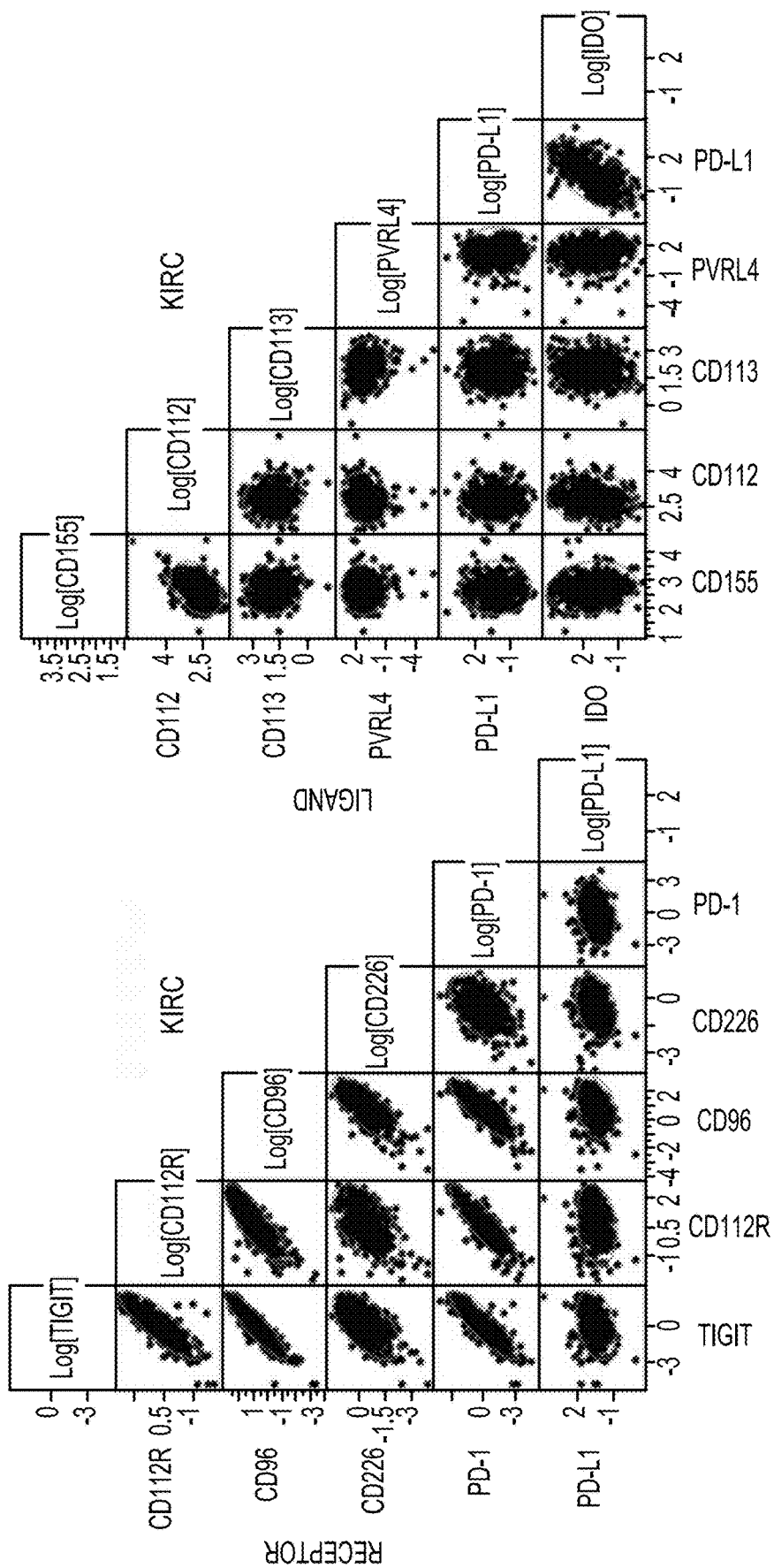

As shown in the top row of FIG. 1A, most of the TIGIT family receptors showed positive correlation with each other in most tumor indications, suggesting that many of these receptors are co-expressed in a cancer or tumor setting. In contrast, the ligands of the TIGIT family members showed limited correlation (bottom row of FIG. 1A); the best correlation being CD112 and CD155. The rest did not show good correlation with each other or with PD-L1.

Figures 1, 1A, 2, 3:
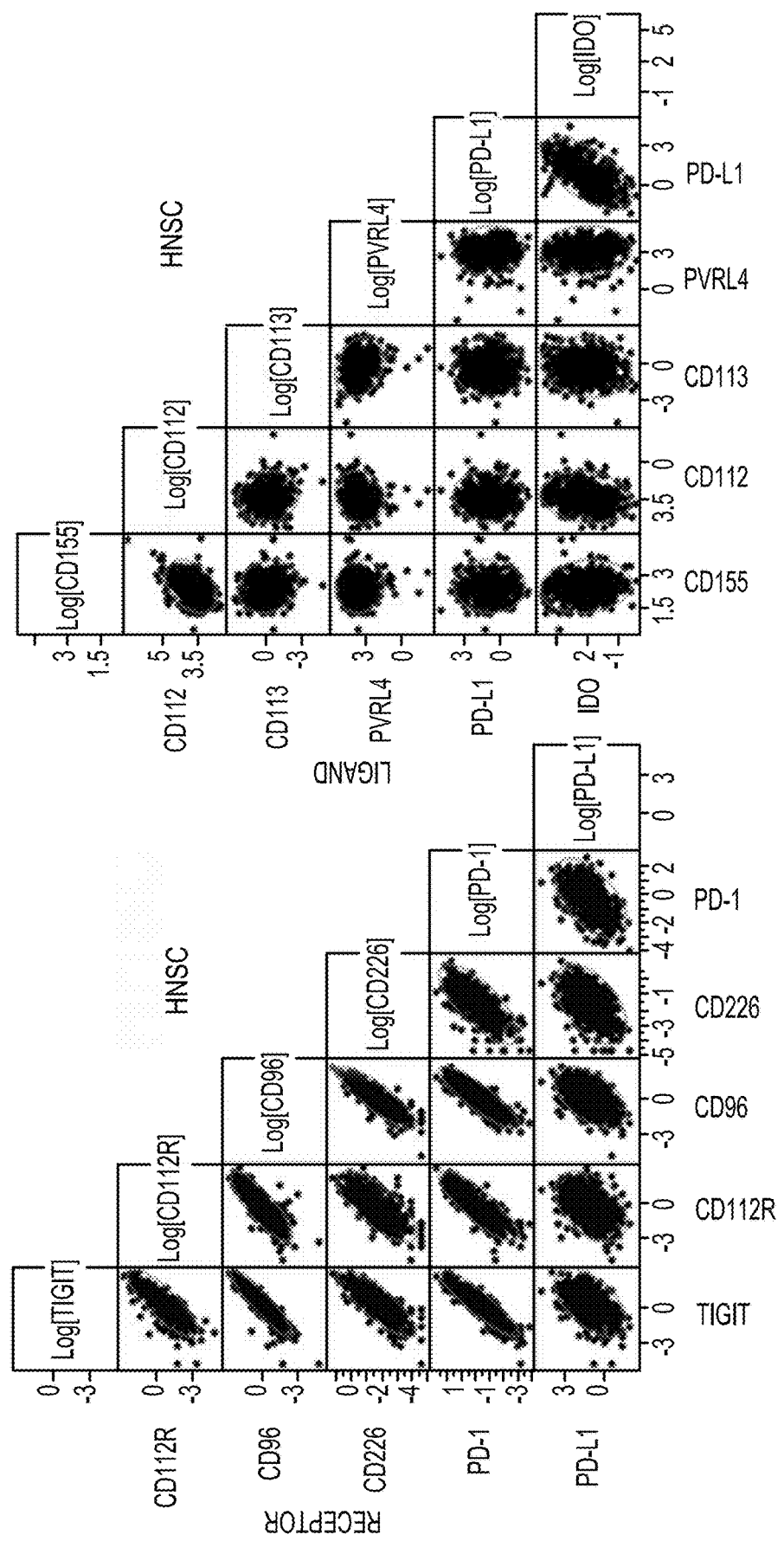
Figures 1, 1A, 2, 3, 4:
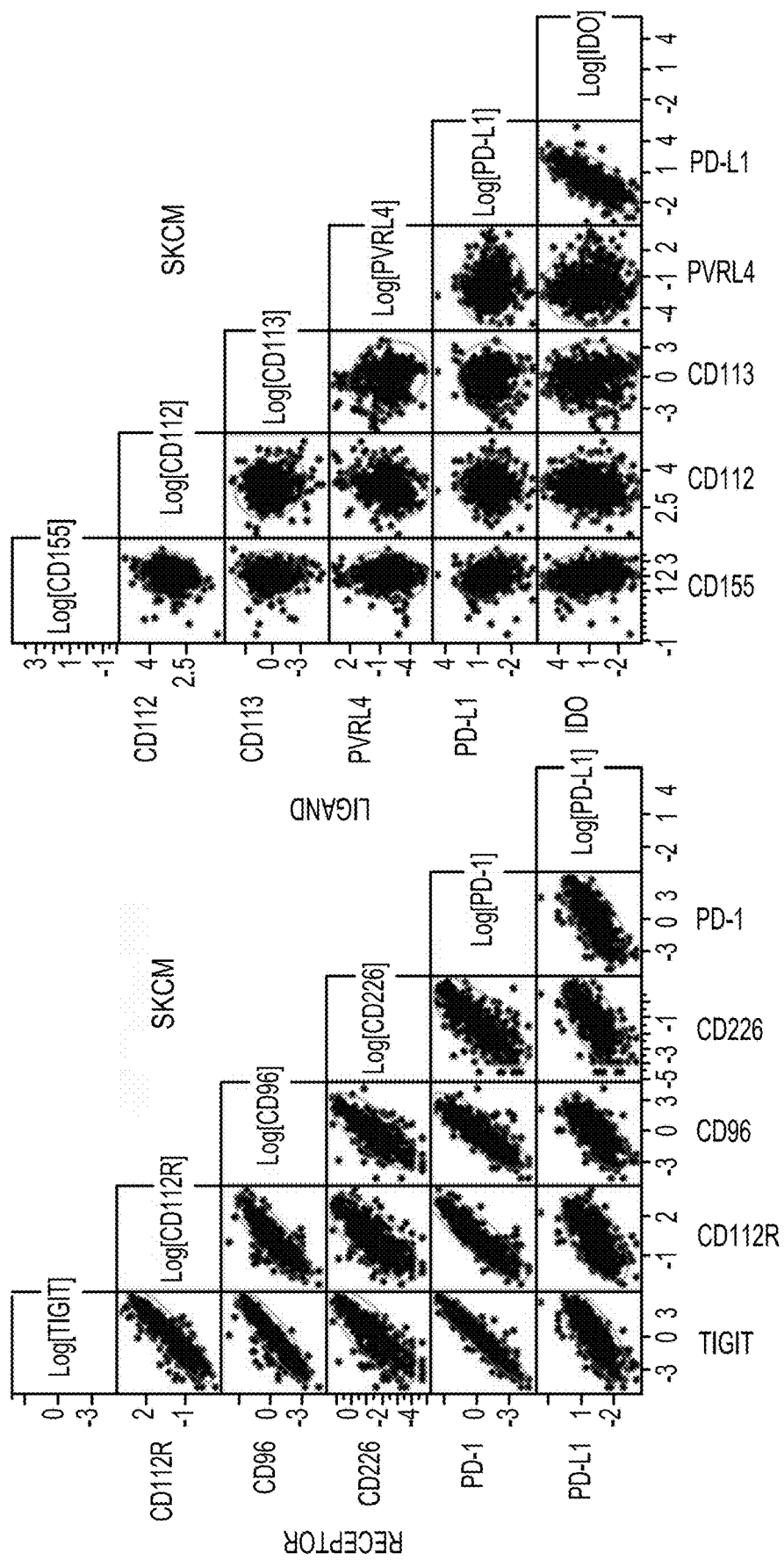
Figure 1B:
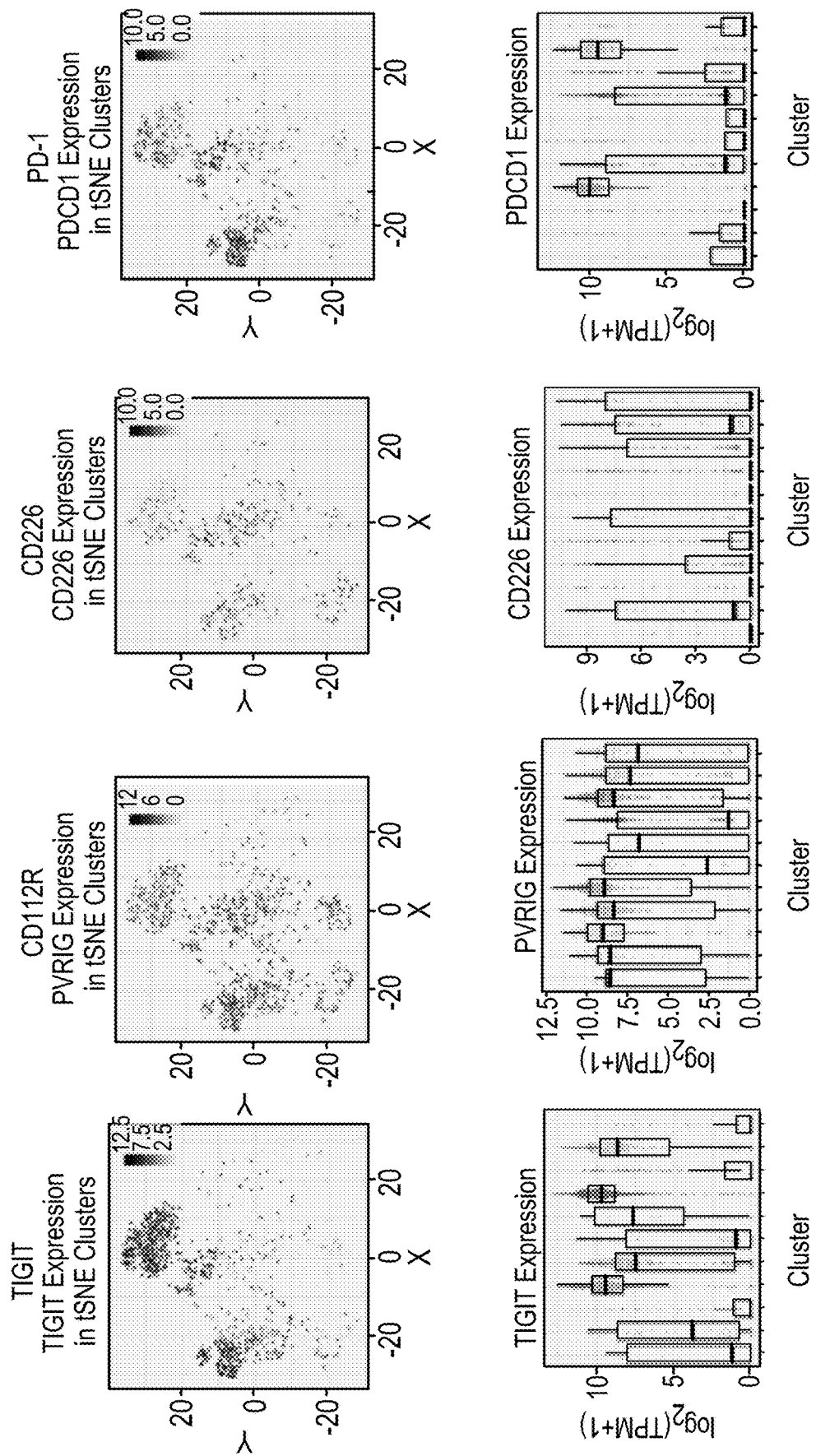
FIG. 1B is a series of plots depicting the expression of TIGIT, CD112R, CD226, or PD-1 (data based on single cell RNA seq data).

Single cell RNAseq data from tumor infiltrating lymphocytes (TILs) from human liver carcinoma also were analyzed, and the data suggested that, while TIGIT and PD-1 expression overlap, CD112R expression was broader (FIG. 1B). Similar results were obtained from additional single cell RNA seq datasets from TILS from colorectal cancer (CRC) and non-small cell lung cancer (NSCLC) (data not shown).

Figures 1C, 1D:
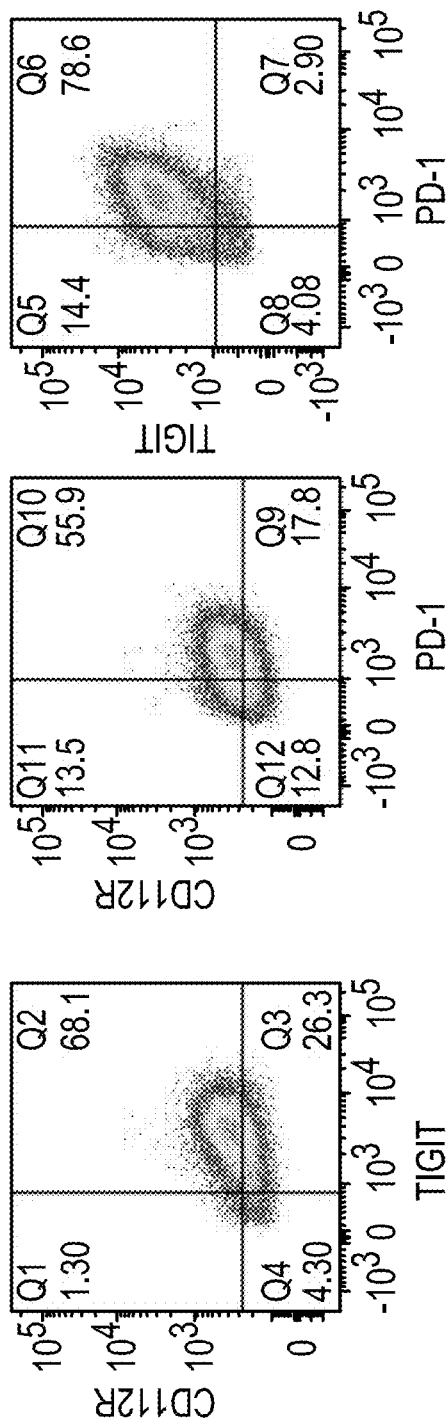
FIG. 1C is a series of FACS plots depicting the co-expression of TIGIT, CD112R, and PD-1.
FIG. 1D is a table listing the % of CD4 T-cells, CD8 T-cells, or Natural Killer (NK) cells positive for expression of CD112R, TIGIT, or PD-1 in tumor infiltrating T/NK cells.

CD112R is the most recent addition to the TIGIT family of receptors. It was previously shown to be expressed on NK cells and activated T cells, and predominantly expressed on CD8 T cells. CD112R expression was confirmed as being induced on CD8 T cell upon activation and that a significant proportion of these cells also co-expressed PD-1 and TIGIT, consistent with the pattern suggested by the scRNAseq data (FIG. 1C).

Figure 1E:
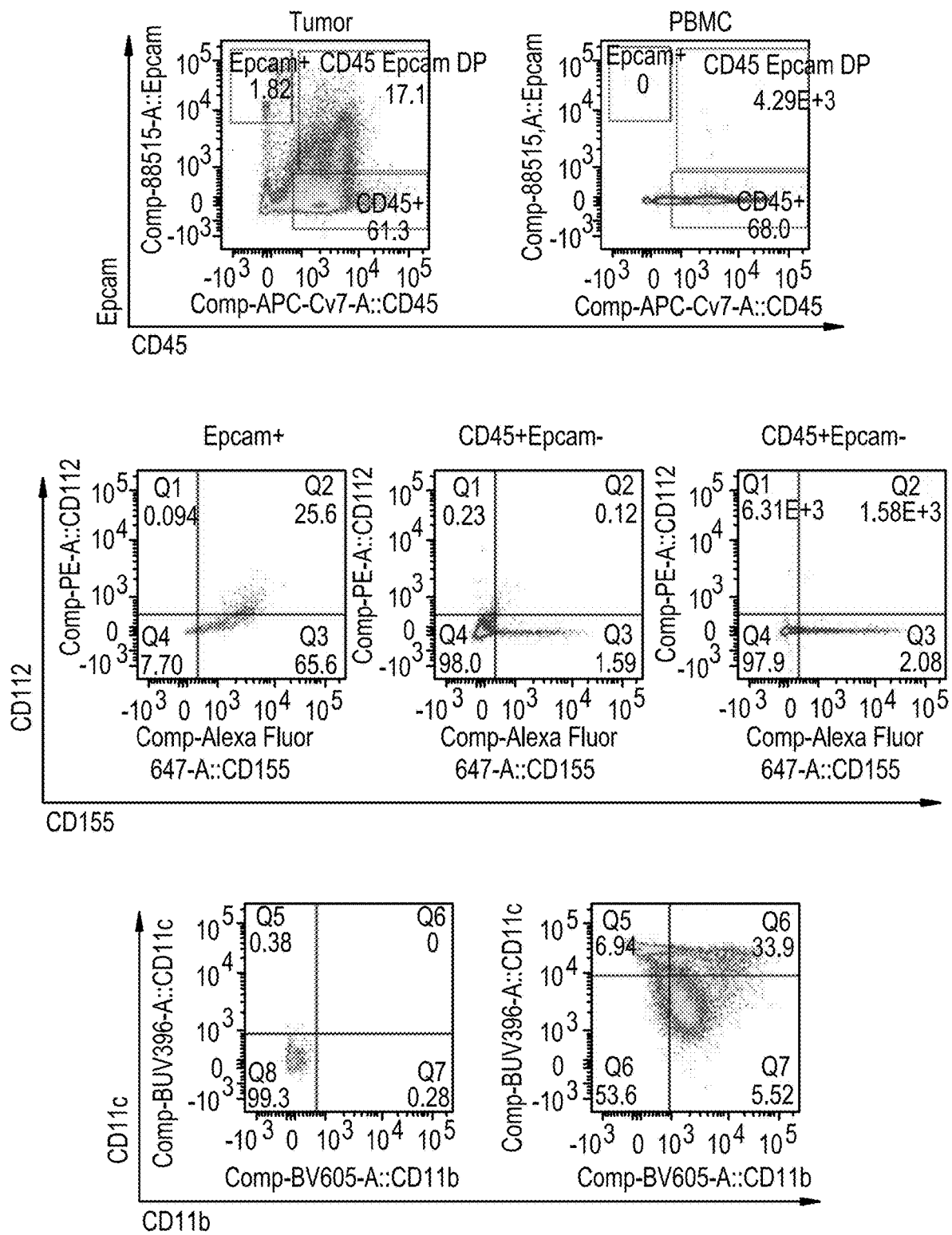
FIG. 1E is a series of plots depicting the expression of Epcam, CD45, CD112, CD155, CD11c, and CD11b in tumor vs. PBMC. CD112 and CD155 expression or CD11c and CD11b expression was assessed on Epcam$^+$, CD45$^+$ Epcam$^+$, or CD45+ Epcam$^-$ populations.

To ascertain the expression of CD112R, TIGIT, and PD-1 and the ligands CD112 and CD155 in primary human cells, the expression of these molecules on tumor-infiltrating immune cells and tumor cells from human tumor tissues was evaluated. Amongst the limited number of samples, the relative expression of the receptors detectable by FACS were highly variable (FIG. 1D). Additionally, it was observed that the ligand expression on Epcam+ CD45− tumor cells versus Epcam− CD45+ immune cells was significantly different. As shown in FIG. 1E, CD112 and CD155 were co-expressed at high levels in Epcam+ CD45− tumor cells but were expressed at low levels on intra-tumor immune cells, with significantly fewer cells expressing both ligands. CD45+ Epcam− myeloid cells in PBMC showed very few, if any, cells co-expressing these ligands.

These results demonstrate the expression patterns for CD112R, TIGIT, and PD-1.

Example 2

This example demonstrates CD112R blockade enhances T cell responses.

Figure 2A:
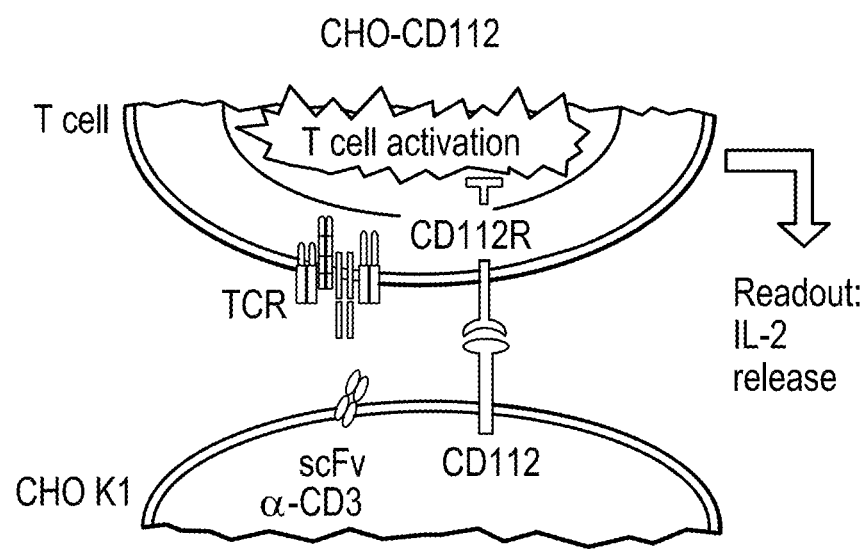
FIG. 2A is an illustration of a Jurkat reporter gene assay (RGA). The assay system uses engineered CHO cells that stably express CD112 and CD3 engager and purified human pan T cells pre-activated with CD3/CD28 antibodies. When CD112R expressed on the surface of the T cells binds to CD112 expressed on the surface of the CHO cells, IL-2 release is expected to be suppressed.
Figure 2B:
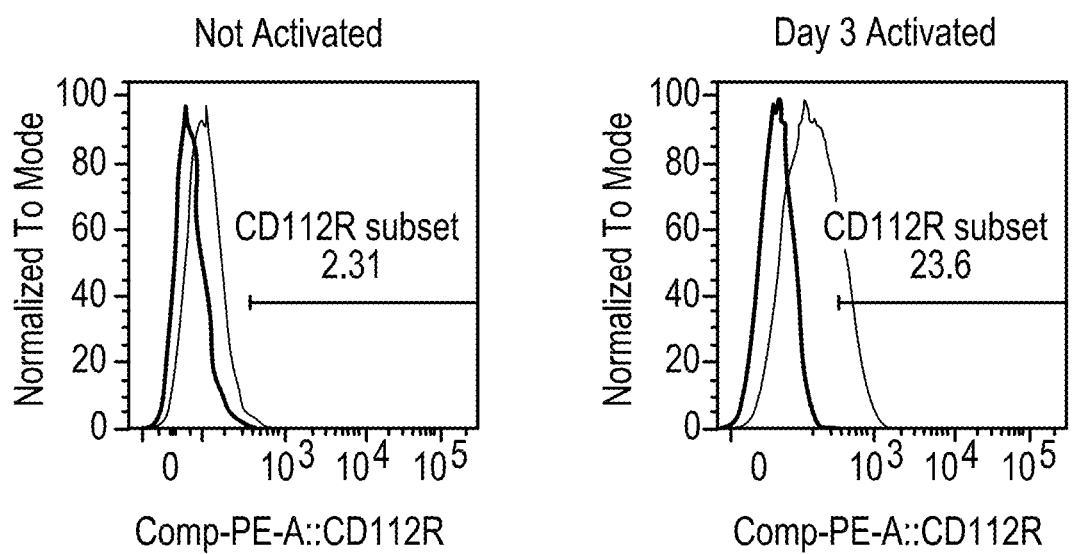
FIG. 2B are graphs depicting the increase of CD112R expression of activated T-cells (right) relative to not activated T-cells (left). CD112R staining profiles are shown against isotype control.
Figure 2C:
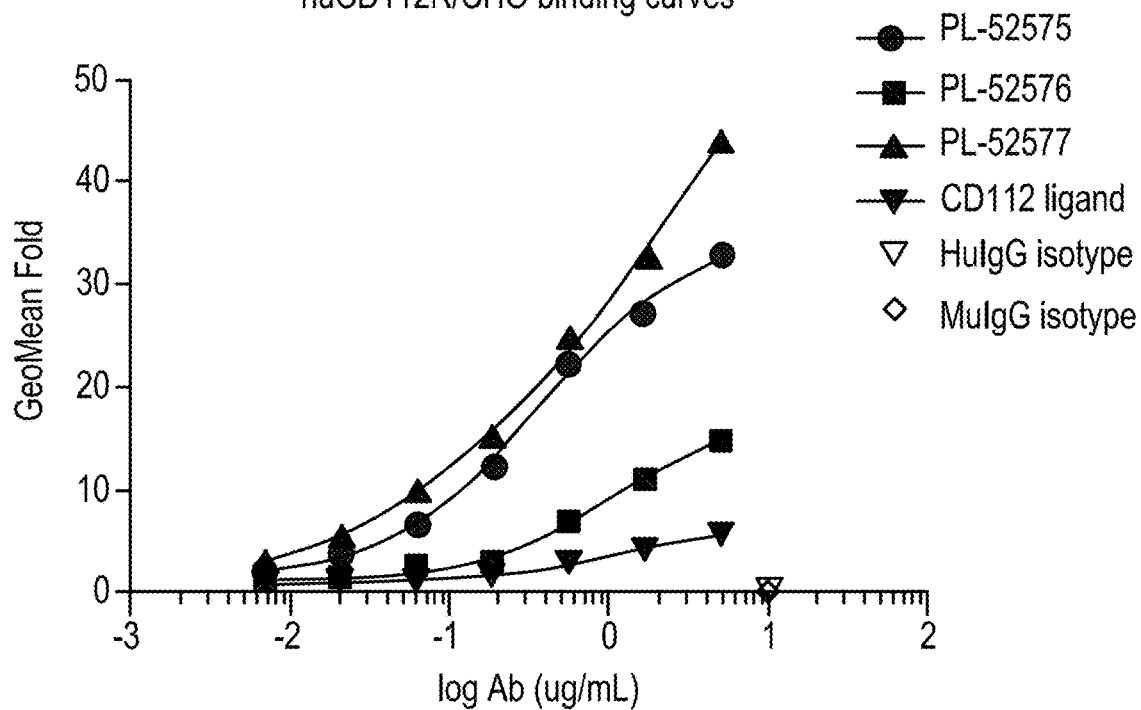
FIG. 2C is a graph demonstrating the binding between antibodies or ligand to CHO cells expressing human CD112R (represented by GeoMean fold) plotted as a function of concentration of tool antibodies (PL-52575, PL-52576, and PL-52577) or human or mouse IgG matched control antibodies (HuIgG isotype and MuIgG isotype, respectively). The binding of CD112 ligand is also shown.
Figure 2D:
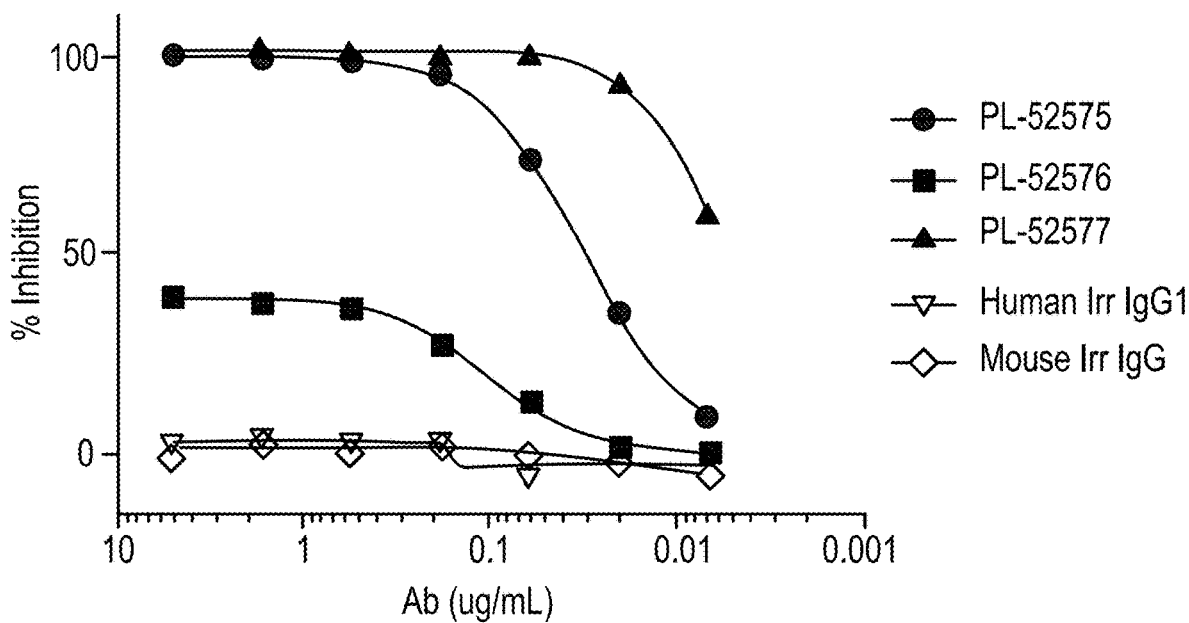
FIG. 2D is a graph demonstrating the calculated % inhibition of the binding between the ligand and human CD112R expressed on CHO cells plotted as a function of concentration of tool antibodies (PL-52575, PL-52576, and PL-52577) or human or mouse IgG matched control antibodies (HuIgG isotype and MuIgG isotype, respectively).

To demonstrate the function of CD112R in T cells, an in vitro assay system using engineered CHO cells that stably express CD112 and CD3 engager was developed. Purified human pan T cells were pre-activated with CD3/CD28 antibodies and then allowed to rest. When CD112R expressed on the surface of the T cells binds to CD112 expressed on the surface of the CHO cells, IL-2 release is expected to be suppressed. An illustration of the assay is provided in FIG. 2A. The T cells were confirmed as having induced CD112R expression on the cell surface (FIG. 2B). The ability of tool antibodies to bind to CD112R and block IL-2 release was tested using this assay system. Tool antibodies (PL-52575; PL-52576, and PL-52577) demonstrated dose-dependent binding to cells expressing huCD112R (FIG. 2C) and the relative affinity/avidity of these antibodies correlated with their ability to block ligand binding (FIG. 2D). A summary of the EC50s and IC50s of these tool antibodies are provided in the table below.

|  | PL-52575 | PL-52576 | PL-52577 | Human CD112 Ligand |
|---|---|---|---|---|
| EC50 (ng/mL) | 388.8 | 1100 | 2913 | 1606 |
| EC50 (nM) | 2.59 | 7.33 | 19.42 | 12.75 |
| IC50 (ng/mL) | 31.9 | 100.3 | 6.4 | Nd |
| IC50 (nM) | 0.21 | 0.67 | 0.04 | Nd |
| Max. Inhibition (%) | 100 | 40 | 101 | |

Figure 2E:
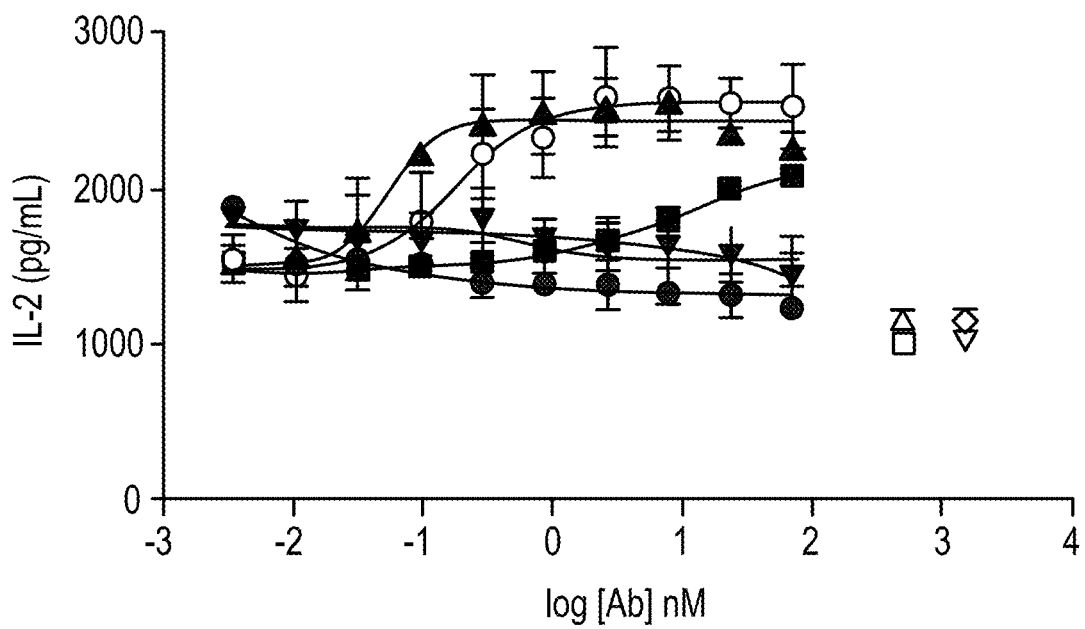
FIG. 2E is a graph of IL-2 concentration (pg/mL) plotted as a function of concentration of tool antibodies (PL-52575, PL-52576, and PL-52577) or human or mouse IgG matched control antibodies (HuIgG isotype and MuIgG isotype, respectively) upon interaction with CHO cells transfected with empty vector (Vector) or vector encoding CD112 (CD112). EC50 for each tool antibody is indicated in the table below the X-axis.

Using this assay system, tool antibodies dose-dependently enhanced T cell activity in the presence of CD112-expressing CHO cells (blue circles, red squares and green triangles of FIG. 2E). The ability of the antibodies to induce activity was dependent on the presence of CD112 on CHO cells, as when CHO cells were mock transfected with empty vector and did not express CD112, the T cell activity was not enhanced. These data suggest that CD112 interaction with CD112R inhibits the T cell response.

Figure 2F:
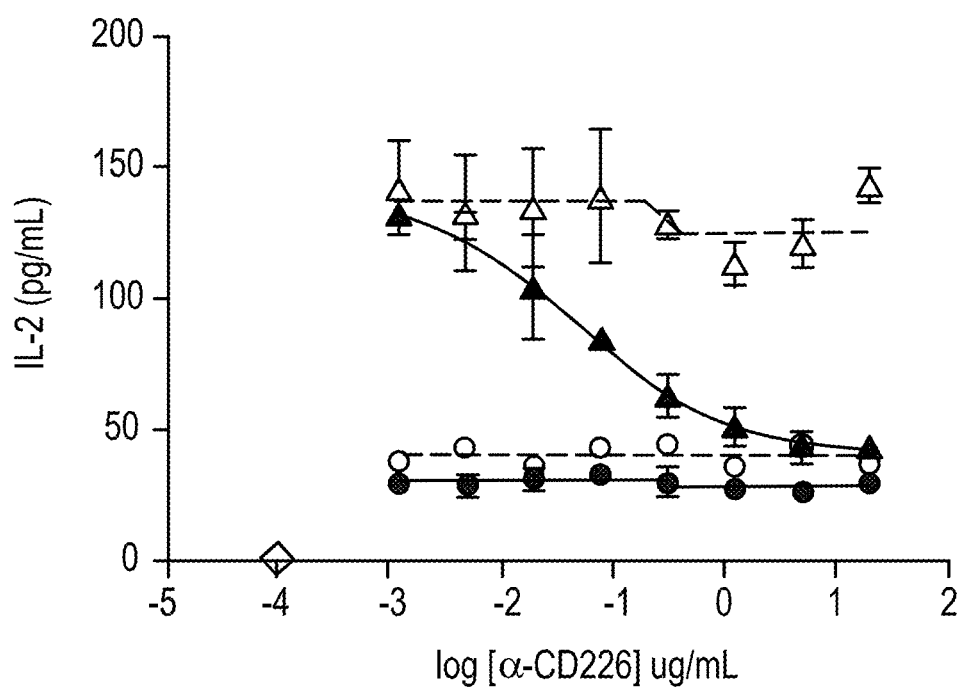
FIG. 2F is a graph of IL-2 concentration (pg/mL) plotted as a function of concentration of CD226 antibody or isotype-matched control antibody in an assay where T cell are co-cultured with CHO cells transfected with empty vector (Vector-CHO) or vector encoding CD112 (CD112-CHO). In one instance, T-cells without any antibody is shown.
Figure 3:
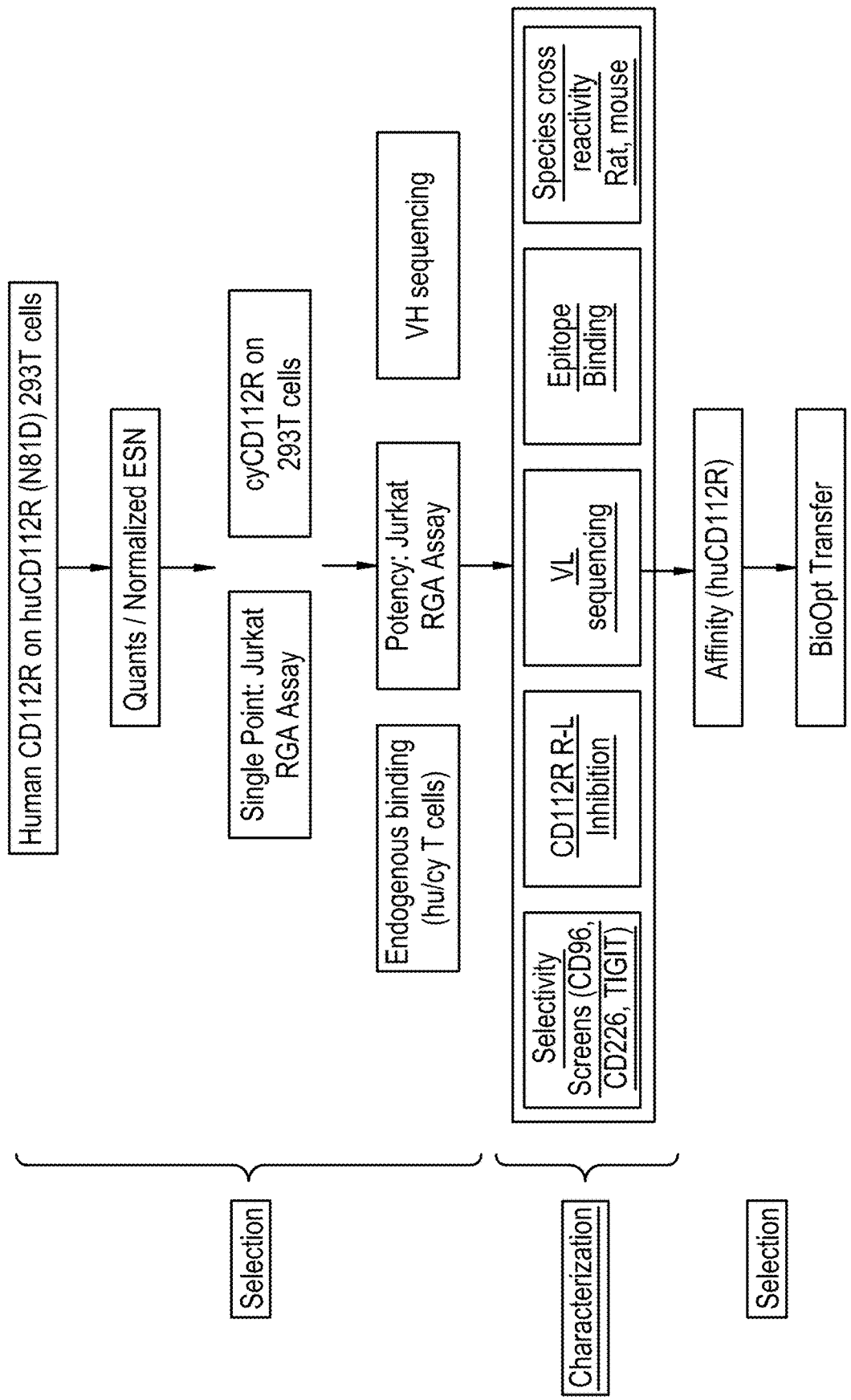

As previously shown, CD112 engages CD226 to induce a costimulatory signal. Importantly, CD112-mediated co-stimulation of T cells, in the absence of CD112R, is entirely driven by CD226 (FIG. 2F), further confirming that CD112R primarily inhibits CD226-dependent costimulatory signal by binding to the same ligand as does CD226.

These results suggest CD112R blockade as a good strategy for enhancing the T cell response.

Example 3

This example demonstrates the generation of CD112R monoclonal antibodies (mAbs).

Full human antibodies to human CD112R were generated as follows.

Generation of Anti-CD112R Immune Responses
Mouse Strains

Fully human antibodies to human CD112R were generated by immunizing XENOMOUSE® transgenic mice (U.S. Pat. Nos. 6,114,598; 6,162,963; 6,833,268; 7,049,426; 7,064,244, which are incorporated herein by reference in their entirety; Green et al., 1994, *Nature Genetics* 7:13-21; Mendez et al., 1997, *Nature Genetics* 15:146-156; Green and Jakobovits, 1998, *J. Ex. Med*, 188:483-495; Kellerman and Green, *Current Opinion in Biotechnology* 13, 593-597, 2002). Animals from the XMG4-K, XMG4-KL, XMG2-K, and XMG2-KL XENOMOUSE® strains were used for these immunizations. In addition, a custom XMG2 CD112R KO mouse strain was generated (Horizon Discovery).

Immunizations

Antibody repertoires were generated using multiple different immunization strategies applied to various XenoMouse strains including the XenoMouse knock out strain XMG2 CD112R KO. Animals were bled, and plasma collected at various time points during the immunization studies ranging from 4 weeks to 10 weeks to asses for CD112R-specific titers.

CD112R-specific serum titers were monitored by live-cell FACS analysis on an Accuri flow cytometer. Briefly, HEK293 cells were mock-transfected or transiently transfected with either human or cynomolgus CD112R. Sera from immunized animals was diluted 100-fold and incubated on the transfected cells for 1 hour on ice. The cells were then washed to remove unbound antibodies and a secondary anti-human IgG Fc specific antibody labeled with Cy5 was incubated on the cells for an additional 15 minutes at 4 degrees. The cells were washed once to remove unbound secondary antibody and fluorescent signal on the cells was quantitated by FACS. Animals with the highest antigen-specific serum native titers directed against human and cynomolgus CD112R were used for hybridoma generation (Kohler and Milstein, 1975). The strains of animals for Harvest land Harvest 3 were XMG2/XMG4, and the strain from Harvest 2 was XMG2k1.

Preparation of Monoclonal Antibodies
Hybridoma Generation

Animals exhibiting suitable serum titers were identified and lymphocytes were obtained from spleen and/or draining lymph nodes. Pooled lymphocytes (from each harvest) were dissociated from lymphoid tissue by grinding in a suitable medium (for example, Dulbecco's Modified Eagle Medium (DMEM); Invitrogen, Carlsbad, CA). B cells were selected and/or expanded using standard methods and fused with a suitable fusion partner using techniques that were known in the art. Antibody producing hybridomas were subsequently plated using FACS-based antigen specific sorting or by standard polyclonal plating techniques.

Antigen Specific Staining of Hybridoma Cells:

Hybridoma cells were removed from the flask and washed in sterile FACS buffer (2% FBS PBS). Cells were then stained with the soluble human CD112R protein and incubated at 4 degrees Celsius for 1 hour. Cells were washed again in FACS buffer and stained with 1 mL of detection cocktail containing 5 µg/mL of Alexa Fluor 488 conjugated F(ab')2 fragment goat anti-human IgG Fc (Jackson, Cat: 109-546-098) and Alexa Fluor 647 conjugated streptavidin (Jackson, Cat: 016-600-084) then incubated at 4 degrees Celsius for 30 minutes in the dark. Cells were washed again in FACS buffer, resuspended in media and then put through a 40-micron cell strainer to remove aggregated cells. Antigen specific cells were sorted using BD FACSAria 3 by gating on population exhibiting both Alexa Fluor 488 and Alexa Fluor 647 fluorescence (IgG+ and antigen binding cells).

The sorted cells were cultured for a few days in hybridoma media. After confirming the successful enrichment of CD112R specific cells, the hybridomas were then single cell sorted into 384-well microtiter plates using BD FACSAria 3. After 2 weeks of culture, supernatants from the microtiter plates were collected and screened for CD112R binding.

Initial Selection of CD112R Specific Binding Antibodies

The order of the screening assays used to identify and select antibodies to human CD112R is shown in FIG. 3.

Human CD112R Specificity Assay

Transfected cells were used to assess an antibody's binding specificity using flow cytometry on host Human Embryonic Kidney (HEK) 293T cells as follows. Proteins were expressed on HEK 293T cells by transfection using human CD112R, murine CD112R, rat CD112R, human CD96, human CD226 or control expression vectors, Gibco™ Opti-MEMO media (Gibco, Cat. No. 31985088) and 293Fectin™ reagent (Invitrogen, Cat. No. 12347019) following the protocol set out by the manufacturer. After 24 hours transfected cells were resuspended in FACS buffer (PBS+2% Fetal Bovine Serum) and added to a 96-well plate. Hybridoma supernatant samples were added such that 2.5 ug/mL final, note the exception of 11E4 which was tested at 1:10 dilution final, cells were resuspended and incubated for 1 hour at 4° C. Plates were washed twice with FACS buffer, centrifuged to pellet the cells, supernatant removed and resuspended in FACS buffer to remove unbound antibody. Alexa Fluor 488-goat anti-human IgG (Fcγ fragment specific) secondary (Jackson ImmunoResearch, Cat. No. 109-545-098) made up in FACS buffer at 5 ug/mL was then added to each well, cells resuspended and incubated for 15 minutes at 4° C. Plates were washed twice with FACS buffer, centrifuged to pellet the cells, supernatant removed and resuspended in FACS buffer to remove unbound secondary antibody. Samples were then resuspended in FACS buffer and read on BD Accuri™ Flow Cytometer with an Intellicyt HyperCyt autosampler. The number of binders to human CD112R for Harvest 1, Harvest 2 and Harvest 3 were 216, 539, and 569, respectively. The huCD112R antibodies were selective for human CD112R and did not cross-react to mouse or rat CD112R (data not shown).

Jurkat Human CD112R/NFAT-Luciferase Reporter Gene Assay (RGA)

Figure 4A:
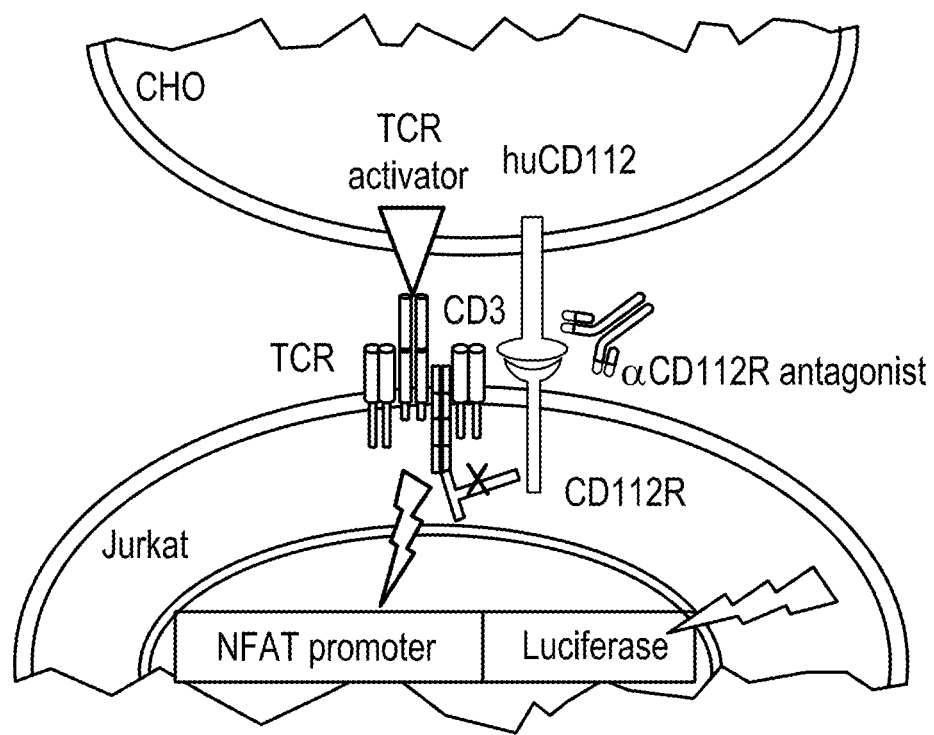
FIG. 4A is a schematic of the Jurkat reporter gene assay (RGA). CHO cells expressing a CD3 engager and CD112 are co-cultured with Jurkat T-cells expressing an NFAT-luciferase construct and CD112R in the presence of antibodies or controls.

To screen for hybridomas or purified anti-CD112R antibodies capable of enhancing T-cell activity by blocking CD112-CD112R interaction, a NFAT reporter assay in Jurkat cells was developed (FIG. 4A). Jurkat cells stably expressing human CD112R and NFAT-luciferase reporter (generated in house using Promega's Jurkat NFAT-luciferase cell line cat #CS176401) were cultured in RPMI 1640 medium (Sigma) supplemented with 10% fetal bovine serum (Sigma), 2 mM L-glutamine (Sigma), 10 mM HEPES (Hyclone, GE Healthcare Life Sciences), 1×MEM NEAA (Sigma), 1× sodium pyruvate (Sigma), 500 ug/mL geneticin (Invitrogen) and 0.5 ug/mL puromycin (Invitrogen). The Jurkat NFAT-luciferase/CD112R Clone C4 cells were stimulated by engagement of the T-cell receptor by co-culturing with Chinse Hamster Ovary (CHO)-K1 cells stably expressing human CD112 and human T-cell engager (generated in house). $1\times10^4$ CHO-K1-CD112+ cells were seeded into white half area 96-well plates (Costar cat #3688) in full growth media containing Nutrient Mixture F12 HAM (Sigma), 10% fetal bovine serum, 10 mM HEPES, 500 µg/mL geneticin, 200 µg/mL hygromycin B (Invitrogen) and 100 ug/mL zeocin (Invitrogen) overnight at 37° C./5% CO2. Following overnight incubation, growth media was replaced by $5\times10^4$ Jurkat NFATluc/CD112R Clone C4 cells in the presence of hybridoma supernatants or antibodies, with respective controls, in Assay Media (RPMI 1640 medium supplemented with 1% fetal bovine serum, 2 mM L-glutamine, 10 mM HEPES) and incubated at 37° C./5% CO2 for 18 hrs. Reporter signal in each well was determined using Bio-GLo Luciferase Assay System (Promega cat #G7940) according to the manufacturer's recommendation. Luminescence was detected using EnVision Plate Reader (Perkin Elmer). For single point assay, human IgG in exhausted hybridoma culture supernatant samples were quantified, normalized to a fixed concentration and tested at 2.0 µg/mL. Antibodies that resulted in a 3-fold or higher induction of NFAT-luciferase signal totaled 216 and were taken forward for subsequent screens.

Primary Cell Binding Assays

The binding of hybridoma supernatants to CD112R expressed by primary human and cynomolgus monkey cells were tested by flow cytometry. For human primary cell binding assay, purified human T cells (Biological Specialty Corp.) were thawed and suspended at a concentration of $2.5\times10^6$ cells/mL. T cells were stimulated with 5 ug/mL of anti-human CD3 clone OKT3 (eBioscience) and 1 µg/mL of anti-human CD28 (BD Pharmingen) for 72 hours at 37° C./5% $CO_2$ in a plate that had been pre-coated with 5 µg/mL anti mouse IgG Fc (Pierce). After 72 hours, cells were removed, washed and suspended at a concentration of $0.5\times10^6$ cells/mL with 10 ng/mL of IL-2 (Pepro Tech). Cells were then incubated for another 5 days at 37° C./5% $CO_2$. For cynomolgus primary cell binding assay, cynomolgus PBMCs (SNBL) were thawed and suspended in a concentration between $4\times10^6$ and $5\times10^6$ cells/mL. PBMCs were stimulated with 1 µg/mL of anti-human CD3 clone SP34 (BD Pharmingen) and 1 µg/mL of anti-human CD28 (BD Pharmingen) for 72 hours at 37° C./5% $CO_2$ in a plate that had been pre-coated with 5 µg/mL anti-mouse IgG Fc (Pierce). After 72 hours, cells were removed, washed and suspended at a concentration of $0.5\times10^6$ cells/mL with 20 ng/mL of IL-2 (Pepro Tech). Cells were then incubated for another 7 days at 37° C./5% $CO_2$.

Complete medium changes with fresh IL-2 additions every 48 to 72 hours were carried out with both human and cyno cells. At each medium change, cells were suspended in a concentration of $0.5\times10^6$ cells/mL. After the final incubation, cells were prepared for flow cytometry by incubation with normalized hybridoma supernatants, positive control antibodies and isotype control antibodies at 10 µg/mL final concentration. Alexa Fluor 647 AffiniPure $F(ab')^2$ Fragment Goat Anti-Human IgG (H+L) (Jackson ImmunoReserach) at 5 µg/mL was used for secondary detection and 8.25 nM YoPro1 (Invitrogen) was used for a live/dead cell stain. Cells were then run on a BD FACSCanto II flow cytometer to detect anti-CD112R antibody binding.

Over 1200 antibodies in wave 1 were identified to bind to human CD112R receptor transiently expressed on 293T cells. Of those, 216 antibodies were found to bind to endogenous human CD112R receptor expressed on Jurkat cells and also function as antagonists of CD112R activity. To identify antibodies that cross-react with the cynomolgus monkey orthologue of CD112R, the panel of >1200 recombinant human binders was tested for binding to recombinant cyno CD112R transiently expressed on HEK293T cells. Two hundred seventy four antibodies of the panel were found to bind to cyno CD112R, only two (11E4 and 1E1) of which were found to bind to endogenous cyno CD112R expressed on primary cyno T-cells.

Second Wave and Antibody Selection

Figure 4B:
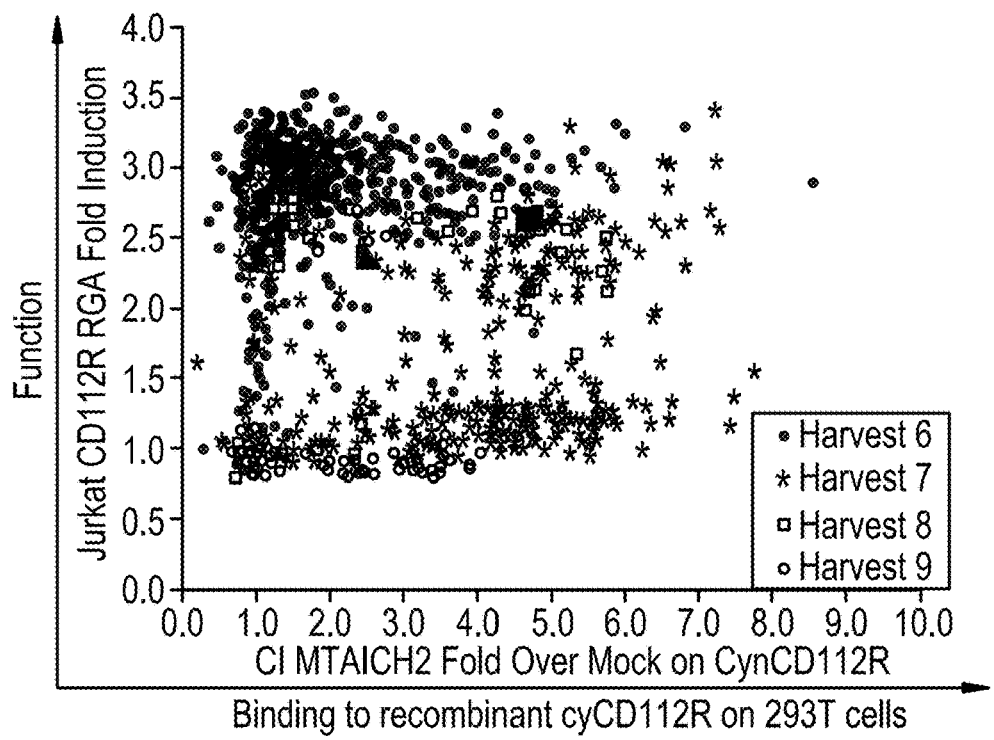
FIG. 4B is a graph of the fold-induction of luciferase activity plotted for Harvests 6-9.
Figure 4C:
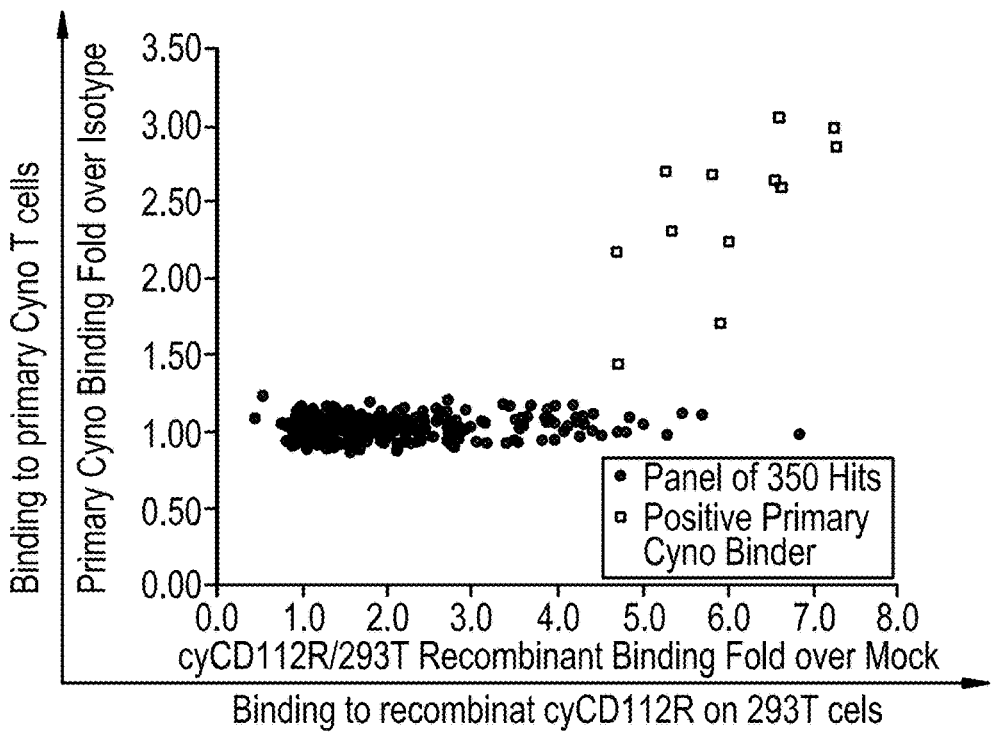
FIG. 4C is a graph of the binding activity to primary cyno T cells plotted for a panel of 350 hits and for positive binders.

A second wave of Xenomouse immunizations involving a custom-generated XMG2 CD112R knock-out (KO) mouse strain, in addition to the XMG2k1 strain, was carried out. Hybridoma cells were generated as essentially described above, and the screening assays described in FIG. 3 were used to identify and select antibodies to human CD112R. Representative data of Harvests 6-9 from the second wave are shown in FIGS. 4B and 4C. The second wave led to over 1300 human CD112R-specific antibodies, of which 350 resulted in a 3-fold or higher induction of NFAT-luciferase signal as determined by the Jurkat RGA. In the wave 2 panel of recombinant human CD112R binders, only 336 bound to recombinant cyno CD112R transiently expressed on 293T cells, and only 27 antibodies bound to endogenous cyno CD112R expressed on primary cyno T-cells.

A summary of characteristics of the antibody harvests from the first and second waves are provided in FIGS. 5A and 5B. Antibodies that demonstrated antagonist function as determined by the Jurkat RGA and antigen binding activity as determined by the human and cyno primary cell binding assays were moved forward to subsequent characterization screens, sequencing, and affinity determination.

High-Throughput KinExA Affinity Ranking of Anti-hCD112R Antibodies with Soluble hCD112R Select monoclonal antibodies specific for human CD112R were affinity ranked using high throughput (HT) KinExA method and using a Kd cutoff of 100 pM. This method is based on the theory that when an antibody is equilibrated with an antigen concentration at Kd cutoff and with the Ab concentration less than the Kd cutoff concentration, then the free Ab present at equilibrium would be 50% or less, if its Kd is 100 pM or less.

Briefly, the experiment was done by equilibrating 25 pM of each antibody with or without 100 pM of hCD112R in PBS/0.05% NaN3/0.01% BSA, for 24 hrs at room temperature. At equilibrium, the free antibody present in the equilibrium mixture and in the antibody alone tube was measured in KinExA. PMMA beads coated with hCD112R was used to capture the free Ab and detected using a mixture of Mu anti-hIgG2, G3, G4+Anti-muIgG (H+L) Alexa647.

The KinExA signal generated by antibody alone is taken as 100% Free and the % inhibited free fraction (IFF) is calculated from the signal measured in presence of antigen as follows:

$$\% \; IFF = \frac{KinExA \; \text{signal obtained in presence of antigen}}{KinExA \; \text{signal obtained in absence of antigen}} * 100$$

The antibodies that demonstrate the lowest % IFF have the highest affinity; conversely, the antibody that demonstrates highest % IFF has the lowest affinity and they can be ranked by plotting the % IFF in a graph. Monoclonal antibodies that give an IFF of 50% or less should have passed the Kd cutoff of 100 pM meaning they should have a Kd of 100 pM or less, respectively.

Figure 6:
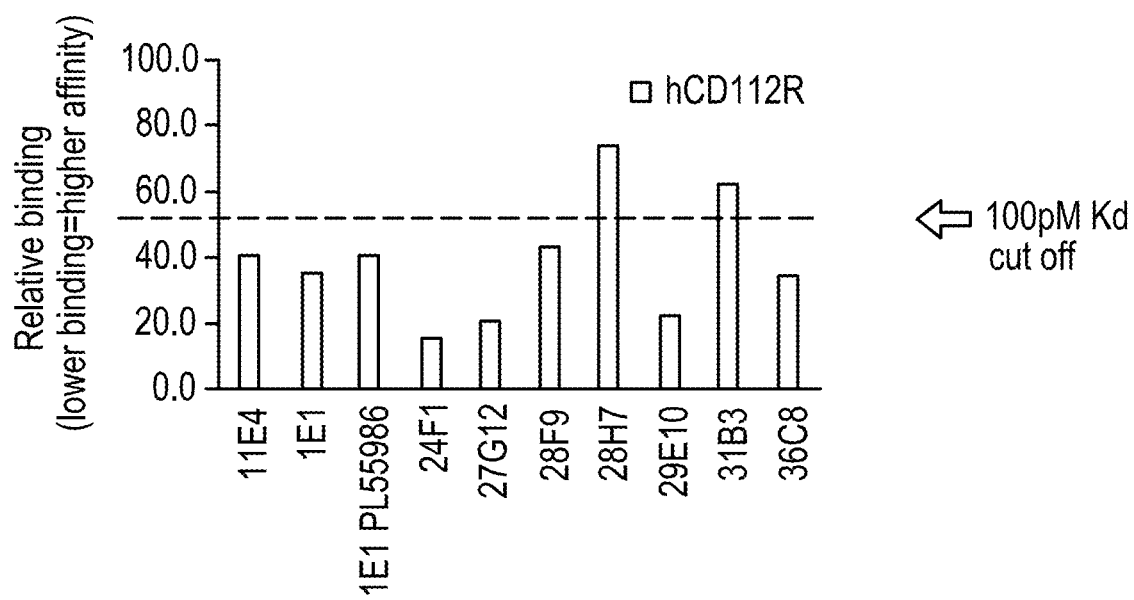
FIG. 6 is a graph of the relative binding activity for CD112R antibodies with 100 pM Kd as an arbitrary cut off threshold.

The results are shown in FIG. 6. Of the ten antibodies analyzed, eight exhibited a $K_D$ below 100 pM and only two exhibited a $K_D$ above 100 pM.

Molecular Rescue and Sequencing of CD112R Antagonist Antibodies

Molecular sequencing of the heavy and light chains of select CD112R antibodies was performed. Briefly, RNA (total or mRNA) was purified from wells containing the CD112R antagonist antibody-producing hybridoma cells using a Qiagen RNeasy mini or the Invitrogen mRNA catcher plus kit. Purified RNA was used to amplify the antibody heavy and light chain variable region (V) genes using cDNA synthesis via reverse transcription, followed by a polymerase chain reaction (RT-PCR). The fully human antibody gamma heavy chain was obtained using the Qiagen One Step Reverse Transcriptase PCR kit (Qiagen). This method was used to generate the first strand cDNA from the RNA template and then to amplify the variable region of the gamma heavy chain using multiplex PCR. The 5' gamma chain-specific primer annealed to the signal sequence of the antibody heavy chain, while the 3' primer annealed to a region of the gamma constant domain. The fully human kappa light chain was obtained using the Qiagen One Step Reverse Transcriptase PCR kit (Qiagen). This method was used to generate the first strand cDNA from the RNA template and then to amplify the variable region of the kappa light chain using multiplex PCR. The 5' kappa light chain-specific primer annealed to the signal sequence of the antibody light chain while the 3' primer annealed to a region of the kappa constant domain. The fully human lambda light chain was obtained using the Qiagen One Step Reverse Transcriptase PCR kit (Qiagen). This method was used to generate the first strand cDNA from the RNA template and then to amplify the variable region of the lambda light chain using multiplex PCR. The 5' lambda light chain-specific primer annealed to the signal sequence of light chain while the 3' primer annealed to a region of the lambda constant domain.

Figure 7A:
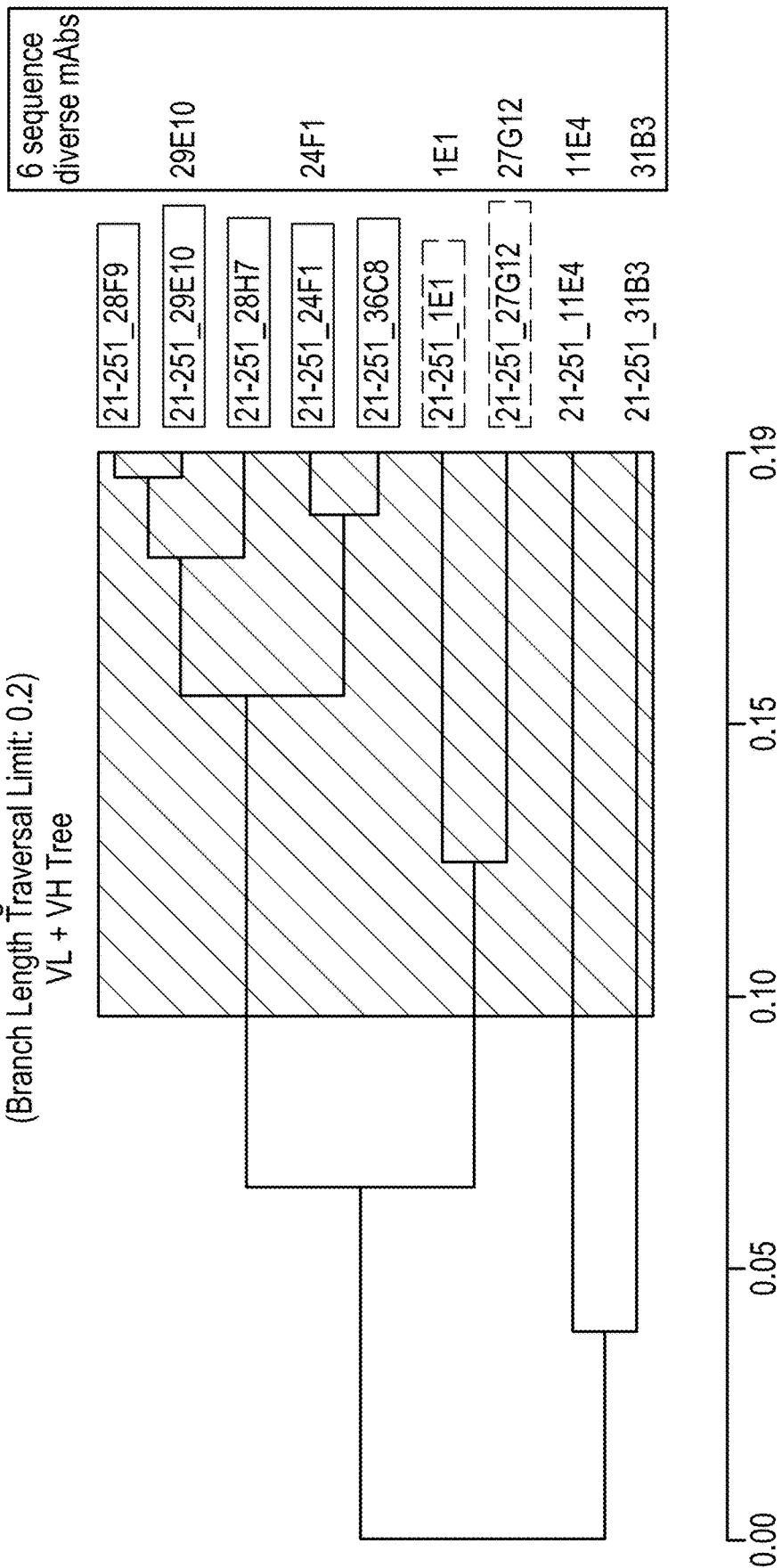
FIG. 7A is a graph of the Clading results showing the sequence diversity of antibodies.

The amplified cDNA was purified enzymatically using exonuclease I and alkaline phosphatase and the purified PCR product was sequenced directly. Amino acid sequences were bioinformatically deduced from the corresponding nucleic acid sequences. Two additional, independent RT-PCR amplification and sequencing cycles were completed for each hybridoma sample to confirm that any mutations observed were not a consequence of the PCR. The derived amino acid sequences were then analyzed to determine the germline sequence origin of the antibodies and to identify deviations from the germline sequence. The amino acid sequences corresponding to complementary determining regions (CDRs) of the sequenced antibodies were aligned and these alignments were used to group the clones by similarity. The sequences were also analyzed for "hotspots" (residues that were computationally predicted or empirically determined to negatively impact the molecule's expression, purification, thermal stability, colloidal stability, long-term storage stability, in vivo pharmacokinetics, and/or immunogenicity). The results of the sequence analysis are shown in FIG. 7A. FIG. 7B lists the antibodies analyzed for sequence diversity and indicates the VH germline and HC CDR3 residues. The IC50 (nM) as determined by the Jurkat RGA for each antibody is also listed. Based on the sequence diversity analysis and hotspot analysis, the antibody list of FIG. 7B was narrowed to the following antibodies for advancing to the next round of screening: 1E1, 11E4, 27G12, 29E10, 31B3 and 24F1.

Human CD112R Receptor-Ligand Competition Assay

Human CD112R-binding hybridoma supernatants were tested for their ability to block human CD112L using flow cytometry on beads as follows. Biotinylated human CD112R-Fc was captured on Streptavidin polystyrene beads (Spherotech, Cat. No. SVP-60-5) in FACS buffer and incubated for 30 minutes at room temperature. Beads were washed twice with FACS buffer, centrifuged to pellet the beads, supernatant removed and resuspended in FACS buffer to remove unbound protein. Biotinylated human CD112R coated beads were added to a 96-well plate. Hybridoma supernatant samples were added such that 5 µg/mL final, beads were resuspended and incubated for 1 hour at room temperature. Zenon™ Alexa Fluor 647 (Molecular Probes, Cat. No. Z25408) labelled CD112-huFc ligand, labelled according to the protocol described by the manufacture, made up in FACS buffer was added at a final concentration of 370 ng/mL, incubated for 15 minutes at room temperature in the dark. Beads were washed once with FACS buffer, centrifuged to pellet the beads, supernatant removed and resuspended in FACS buffer to remove unbound ligand. Samples were then resuspended in FACS buffer and read on BD Accuri™ Flow Cytometer with an Intellicyt HyperCyt autosampler.

Figure 8:
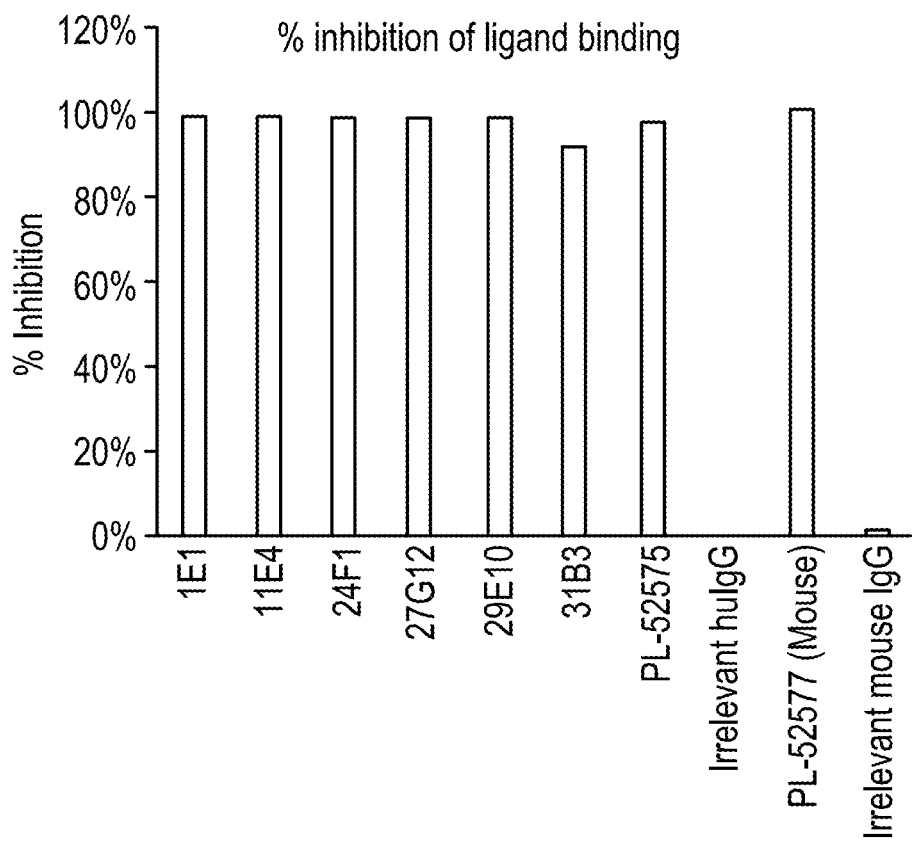
FIG. 8 is a graph of the % inhibition of the binding achieved by the indicated antibody or tool antibody (PL-52575, PL-52577). Irrelevant mouse and human antibodies are used as controls. The table below the X-axis lists EC50 values and the max % inhibition for each tool antibody.

The results are shown in FIG. 8. As shown in this figure, all six antibodies (1E1, 11E4, 27G12, 29E10, 31B3 and 24F1) demonstrated significant inhibitory activity, preventing about 90% or more CD112 ligand from binding to the CD112R receptor. The inhibitory activity of the six antibodies were comparable to those of two reference anti-CD112R antibodies, PL-52575 and PL-52577, having IC50s as 0.12 nM and 0.10 nM, respectively.

Competition-Based Binning for the Lead Panel of CD112R Antibodies

Select human CD112R-binding hybridoma supernatants were tested for competition-based binning by utilizing the Octet HTX platform. Antibodies were loaded on Anti-HuFc (kinetic) biosensors ForteBio cat 18-5064 at 2 ug/mL for two minutes in an assay buffer comprising 10 mM Tris, 0.1% Triton, 150 mM NaCl, 1 mM CaCl2, 0.1 mg/mL BSA, pH7.4. The biosensors were subsequently blocked with 50 µg/mL irrelevant HuIgG2 in assay buffer for five minutes. CD112R at 1 µg/mL was bound for two minutes in assay buffer, then the biosensors were dipped in assay buffer for one minute to establish a baseline signal. After the baseline signal was established, antibodies at 2 µg/mL (which were different from the antibody bound to the biosensors) were tested for the ability to outcompete the biosensor-bound antibody for the binding to CD112R. Data was analyzed using ForteBioHT data analysis software V11.1 in which the signal at the end of the second antibody binding step is determined. If the signal at the end of the second antibody binding step is different from baseline, then the second antibody outcompetes the first antibody for binding to CD112R.

A schematic of the steps of this assay are shown in FIG. 9A. In this schematic, the antibody 31B3 is bound to the biosensor. If the antibody used in the second antibody binding step is the same as the antibody bound to the biosensor, then the signal does not change relative to baseline. See aqua blue line. However, if the antibody used in the second antibody binding step is different from the antibody bound to the biosensor, e.g., 24F1, and the signal is higher than the baseline signal, then the second antibody is placed into Bin A. See purple line. If the antibody used in the second antibody binding step is different from the antibody bound to the biosensor and the signal is not higher than baseline, then the antibody is placed into Bin B.

The results are shown in FIG. 9B. As shown in this figure, antibodies 24F1, 27G12, 29E10, 1E1, and 11E4 all competed with each other and were assigned to Bin A. Antibody 31B3 did not compete with the other antibodies and thus was assigned to Bin B.

Binding Confirmation to Primary Human and Cyno T-Cells

Primary human and cyno T-cells were prepared and analyzed as essentially described above. Exhausted hybridoma culture supernatants containing the antibodies 1E1, 11E4, 27G12, 29E10, 31B3 and 24F1 were quantitated, then titrated for binding on the surface of primary T-cells. Curve fitting analysis using Prism allowed determination of an EC50 value for binding to the primary cells.

For all antibodies 1E1, 11E4, 27G12, 29E10, 31B3 and 24F1, the EC50 values for binding to human T-cells was within 10-fold for binding to the cyno PBMCs.

Briefly, cultured human T cells and cyno PBMCs were incubated with lead panel starting at 3 µg/mL for human or 5 µg/mL for cyno and titrated 1 in 3 for the lowest concentration of 0.001 µg/mL for human and 0.002 µg/mL for cyno. AF 647 gt anti hu IgG Fc at 5 µg/mL was used as a secondary and YoPro1 was used as a live/dead cell stain. Exhausted supernatant (ESN) was used for all leads except for 1E1 and 1E3, for these two, purified mAb was used. 11B1 which is a structurally close to 11E4 was used in the assays as there was not enough 11E4 ESN. For analysis, FCS Express was used to obtain Geo Means and Screener was used to determine fold over Isotype control, titration curves and EC50 values.

Figure 10A:
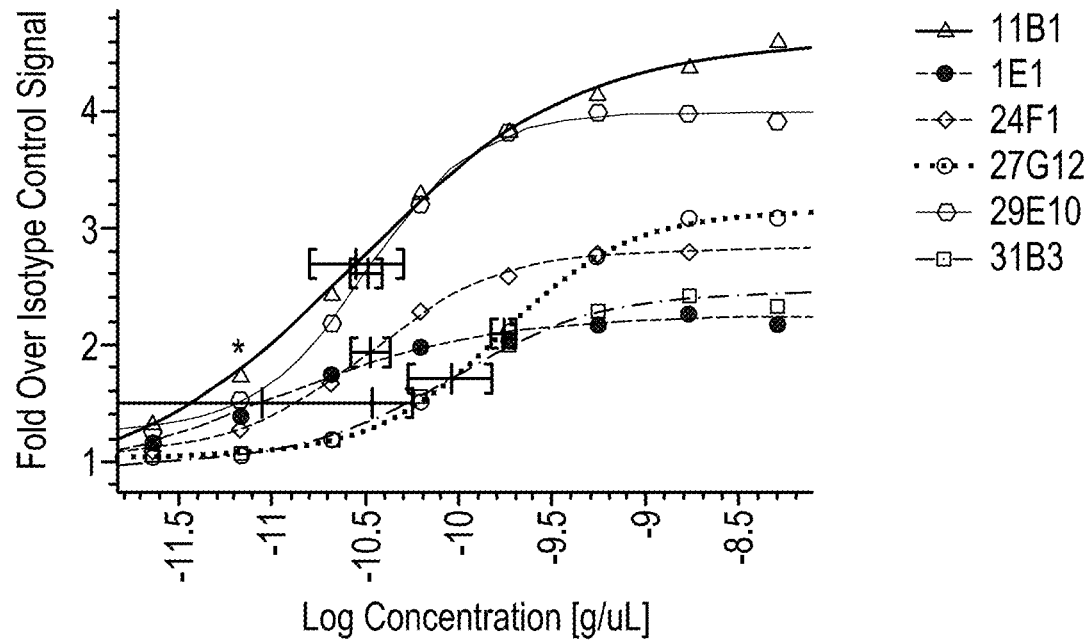
FIGS. 10A and 10B is a graph of the fold over isotype control plotted as a function of concentration of the indicated antibody. The results of the assay using cyno PBMCs and human T-cells are shown in FIGS. 10A and 10B, respectively. The graphs of FIGS. 10A and 10B plot the fold over isotype control signal plotted as a function of the log concentration of the indicated antibody.
Figure 10B:
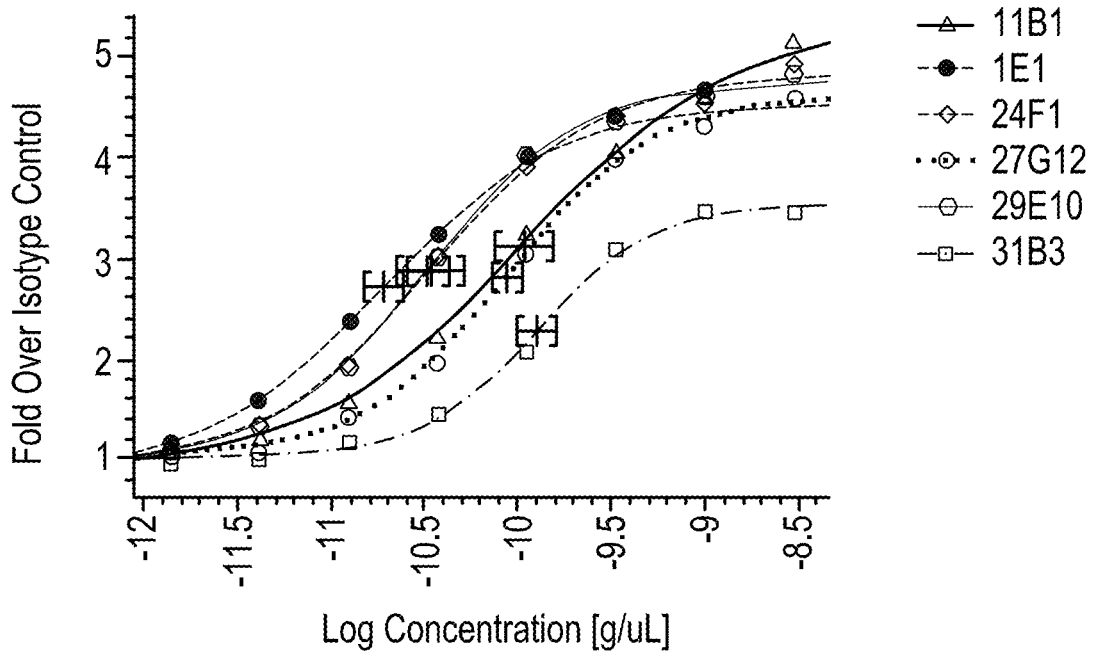

The results of the assay using cyno PBMCs and human T-cells are shown in FIGS. 10A and 10B, respectively, and Table 1. The graphs of FIGS. 10A and 10B plot the fold over isotype control signal plotted as a function of the log concentration of the indicated antibody. Table 1 provides the EC50 (ng/µL) for each antibody.

TABLE 1

| Antibody | EC50 (ng/µL) for CD112R on Cyno PBMCs | EC50 (ng/µL) for CD112R on human T-Cells |
|---|---|---|
| 1E1 | 0.0087 | 0.020 |
| 29E10 | 0.0322 | 0.033 |
| 24F1 | 0.0334 | 0.034 |
| 27G12 | 0.1737 | 0.089 |
| 11B1* | 0.0281 | 0.108 |
| 31B3 | 0.898 | 0.127 |

*Structurally similar to 11E4

As shown in Table 1, 1E1 exhibited the highest binding affinity for CD112R expressed by primary human and cyno cells. The EC50s of 29E10 and 24F1 were very similar between the two species and to each other. 11B1 had a high EC50 of 0.108 ng/µL for Human but a low EC50 of 0.0281 ng/µL for Cyno.

Potency Confirmation

Figures 11A, 11B:
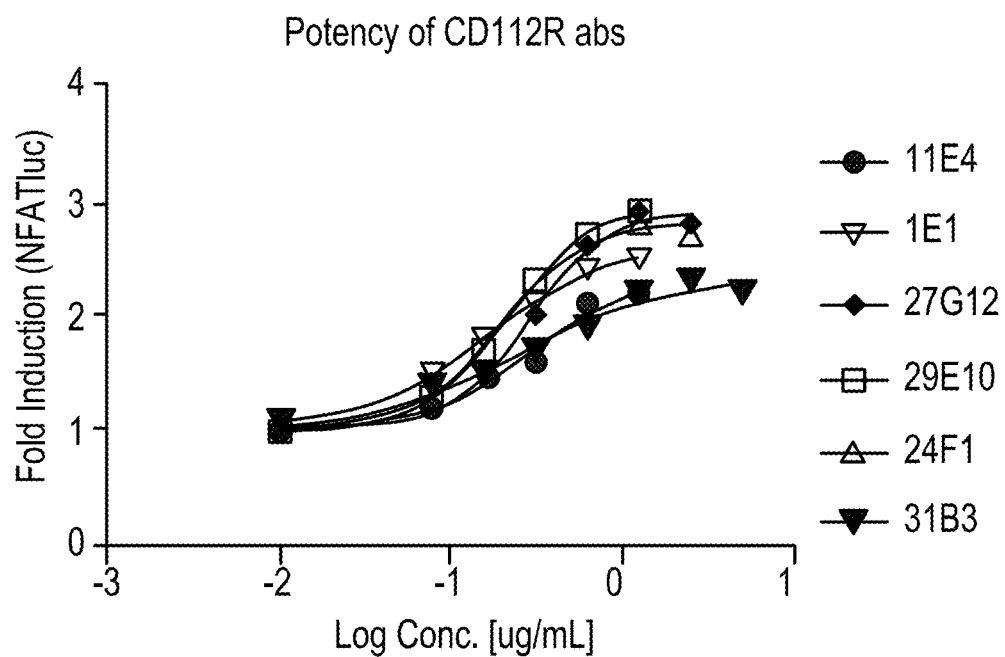
FIG. 11A is a graph of the NFAT luciferase activity plotted as a function of concentration of the indicted antibody.
FIG. 11B is a table listing the EC50 of the antibody as determined in the Jurkat RGA.

Jurkat human CD112R/NFAT-luciferase reporter gene assay (RGA) was run as essentially described above for single point analysis on exhausted hybridoma culture supernatant samples or purified antibodies that were serially titrated 2-fold in assay media to determine final potency of the antibody panel. The results are shown in FIG. 11A which provides a graph of the NFAT luciferase induction plotted as a function of log concentration of the indicated antibody. As shown in FIG. 11, all antibodies tested demonstrate potency as CD112R antagonists. The potency on re-exhausted hybridoma culture supernatants were very close (ranging between 1.3-3.5 nM (FIG. 11B)

Hotspot Engineering of CD112R Antibodies

Select anti-CD112R antibodies were converted to a standard antibody format of the IgG1 subtype by fusing the VL domain of kappa light chains to Cκ domain and VH domains to the CH1-CH2-CH3 sequence. The CH2 domain of this antibody isotype has been engineered for reduced effector function by incorporating an N297G mutation and for improved thermostability through an engineered disulfide bond (R292C, V302C); this antibody isotype is designated SEFL2-2. The anti-CD112R antibodies were additionally engineered to remove "hotspots," or residues that were computationally predicted or empirically determined to negatively impact the molecule's expression, purification, thermal stability, colloidal stability, long-term storage stability, in vivo pharmacokinetics, and/or immunogenicity. A variety of amino acid mutations at these hotspots were designed based on conservation, co-variation, chemical similarity, predictions from structural modeling, and prior knowledge from other antibody engineering campaigns. Engineered antibodies were designed that included both single mutations and combinations of mutations.

Engineered variants were cloned by ordering synthetic DNA fragments comprising the designed variable domains and inserting these using Golden Gate cloning methods into a stable mammalian expression vector containing the constant HC domains under puromycin selection or the constant LC domains under hygromycin selection. Antibodies were expressed by co-transfecting HCs and LCs in CHO-K1 cells and selecting for stable expression using puromycin and hygromycin. Antibodies were purified by Protein A affinity chromatography using AmMag™ Protein A Magnetic Beads (GenScript). The identity of each molecule was confirmed by intact mass spectrometry. For each variant, the expression titer in conditioned medium was measured by ForteBio Octet (Pall Life Sciences) using Protein A sensors. The percent of high molecular weight (% HMW) material present after Protein A affinity chromatography was measured by analytical size exclusion chromatography, and the purity was measured by % main peak in non-reduced microcapillary electrophoresis using a LabChip GXII (Perkin Elmer). The Tm of the first melting transition (Tm 1) and the onset temperature of aggregation (Tagg) were measured by DSF using a Prometheus (Nanotemper). Antibody activity was measured by the CD112R Jurkat reporter gene assay as described above, averaging two independent measurements. The results of the analyses for engineered variants are shown below in Table 2.

Framework Engineering of CD112R Antibodies

Anti-CD112R antibody 11E4 (comprising HC variable region sequence and LC variable region sequence of SEQ ID NOs 101 and 102, respectively) was engineered for improved manufacturability by grafting the CDRs of each antibody into selected alternate human frameworks with a preference for well-behaved VH1, VH3, VH5, VK1, and VK3 germlines. The alternate frameworks were selected by considering sequence similarity. The pre- and post-graft sequences were carefully examined, especially at the graft junctions, and in some cases targeted backmutations were designed to provide the best chance of retaining functional conformation of the CDR loops.

Framework engineered variants were cloned by ordering synthetic DNA fragments comprising the designed variable domains and inserting these using Golden Gate cloning methods into a stable mammalian expression vector containing the constant HC or LC domains and purified by Protein A affinity chromatography using AmMag™ Protein A Magnetic Beads (GenScript). The identity of each variant was confirmed by intact mass spectrometry. For each variant, the expression titer in conditioned medium was measured by ForteBio Octet (Pall Life Sciences) using Protein A sensors. The percent of high molecular weight (% HMW) material present after Protein A affinity chromatography was measured by analytical size exclusion chromatography, and the purity was measured by % main peak in non-reduced microcapillary electrophoresis using a LabChip GXII (Perkin Elmer). The Tm of the first melting transition was measured by DSF using a Prometheus (Nanotemper). Purified samples were incubated at 40° C. for 2 weeks and the change in % main peak was determined by analytical size exclusion chromatography. Antibody activity was measured by the CD112R Jurkat reporter gene assay as described above, averaging two independent measurements. The results of the analyses for engineered variants are shown in Table 3.

Yeast Display Engineering of CD112R Antibodies

Anti-CD112R antibodies 31B3, 11E4, 29E10, 1E1.016, and 24F1 were engineered for improved manufacturability and for increased binding to CD112R through yeast display. Library designs for 11E4 and 1E1.016 used a CDR walk in triplicate across the CDRs to cover all CDR amino acids including the chemical hotspot liabilities. The other 4 antibodies had libraries designed specifically around their chemical hotspot liabilities and residues predicted to contribute to poor surface properties, determined through homology modeling and patch analysis by the BioLuminate computational modeling software package (Schrödinger, LLC, New York, NY, 2020). Libraries were sorted using fluorescence activated cell sorting (FACS) for high binding to biotin conjugated recombinant CD112R extracellular domain (ECD) using streptavidin PE as fluorescence secondary. The variable domains present in the sorted binding/display double positive pools and display positive pools were amplified with primers specific to the FW1 and FW4 domains of the HC and LC and submitted to NGS analysis on an Illumina MiSeq for a 2×300 bp run. Mutations were selected after processing the data through a common frequency analysis where the ratio of positive binding amino acid frequencies are divided by positive display amino acid frequencies which is then normalized to the parental sequence ratio. The sequences where the enrichment values were greater than or equal to the parental sequence were considered beneficial or tolerated diversity and were used for additional rational antibody engineering post affinity maturation. For the selection of improved affinity, a new chain shuffle library was constructed using the sequences of the binder pools from the HC and LC libraries, which had binding greater than or equal to parent. These libraries were then enriched for 3 rounds for sequences that retained binding to CD112R on yeast under decreasing concentrations each round. Individual yeast clones were subsequently analyzed for binding and sequenced, resulting in the selected affinity matured/poor property remediated variants. Variants were cloned into recombinant expression systems as described above. The results of the analyses for engineered variants are shown below in Tables 4 and 5.

Example 4

This example demonstrates preliminary biochemical and functional experiments conducted to characterize tool TIGIT antibodies.

Figure 12A:
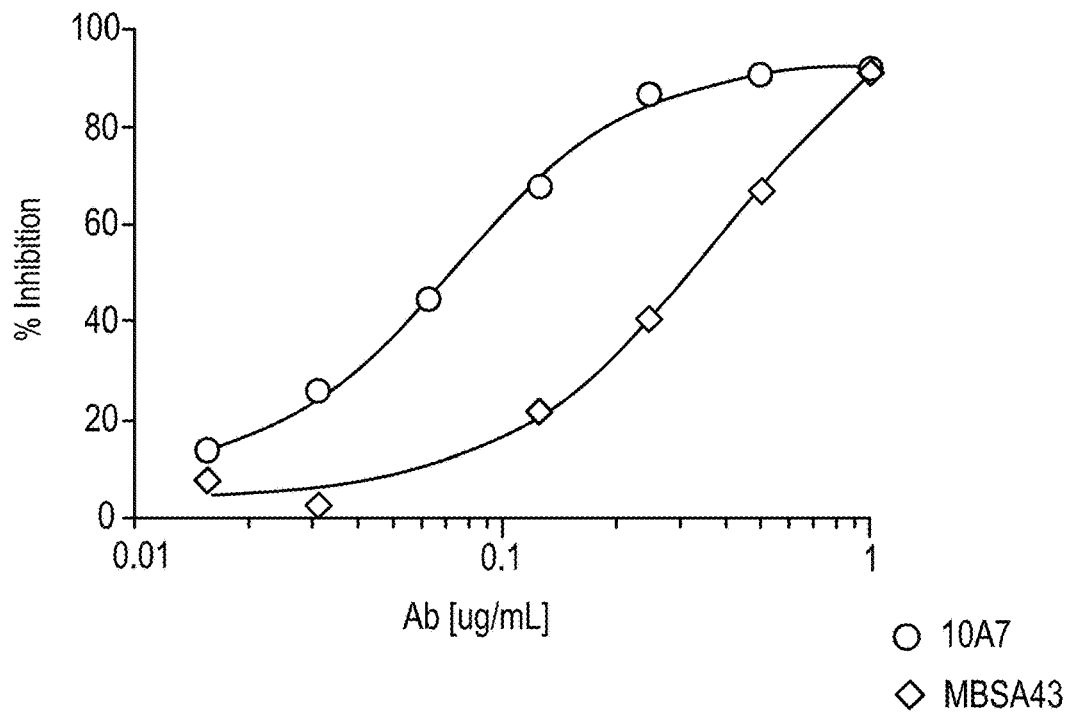
FIG. 12A is a graph of the % inhibition of binding of TIGIT to CD155-Fc plotted as a function of tool TIGIT antibody concentration.
Figure 12B:
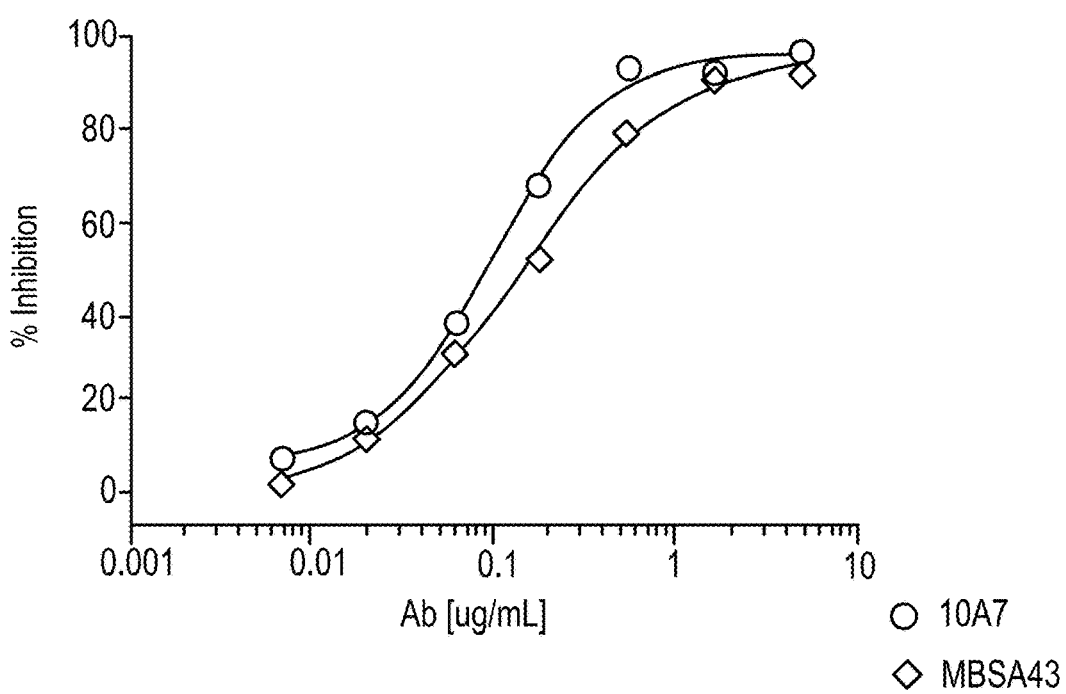
FIG. 12B is a graph of the % inhibition of binding to CD112-Fc as a function of antibody concentration.

Competitive receptor-ligand (R-L) binding assays were performed on TIGIT antibodies 10A7 (Genentech TIGIT antibody) and MBSA43 (eBioscience™ cat #16-9500-85) using CHO-S cells transiently expressing human TIGIT. Briefly, CHO-S cells expressing human TIGIT were mixed with an antibody sample and incubated for 1 hour at 4° C. in FACS Buffer (1×PBS pH7.4+2% Fetal Bovine Serum). Cells with bound sample were then incubated with 2.5 μg/mL huCD155-Fc-Alexa 647 (generated & labelled in-house) or 15 μg/mL CD112-Fc-Alexa 647 (Sino Biological 10005-H02H; labelled in-house) for 45 minutes at 4° C. 7-AAD (Sigma cat #A9400-5MG; 7.5 μg/mL) cell viability stain was then added and the cells were incubated for a further 15 minutes at 4° C., washed twice and resuspended in FACS buffer. Samples were analyzed using a BD Accuri™ Flow Cytometer and an Intellicyt HyperCyt autoSampler. The results are shown in FIGS. 12A and 12B. FIG. 12A is a graph of the % inhibition of binding of TIGIT to CD155-Fc plotted as a function of tool TIGIT antibody concentration. FIG. 12B is a graph of the % inhibition of binding to CD112-Fc as a function of antibody concentration. The results shown in FIGS. 12A and 12B demonstrate that 10A7 and MBSA43 tool antibodies inhibit both CD155 and CD112 interactions with TIGIT.

Figure 12C:
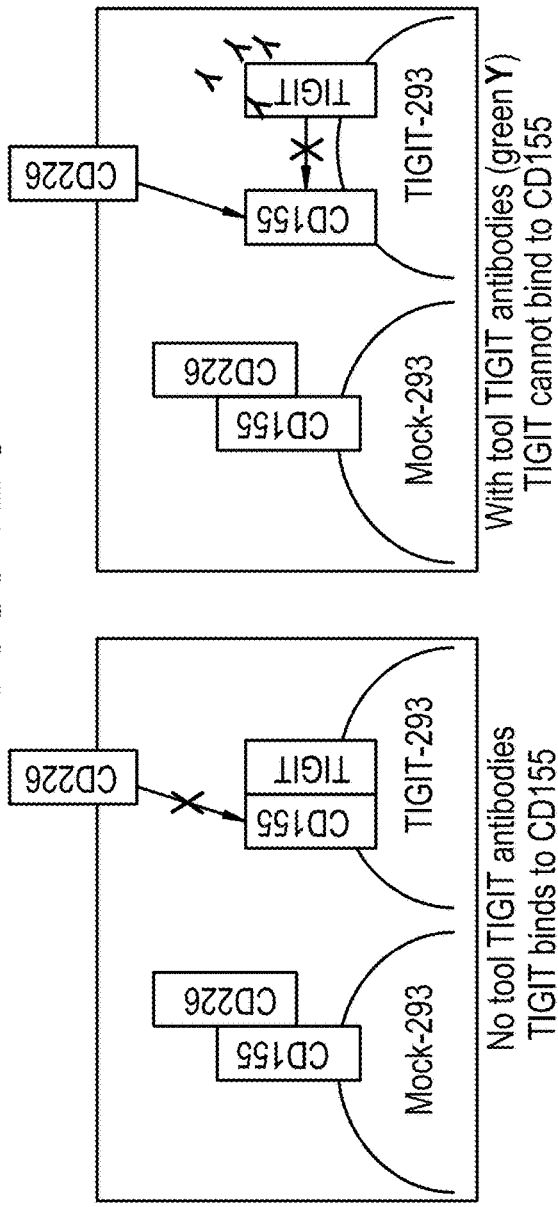
FIG. 12C is an illustration of a cellular assay to test activity of tool TIGIT antibodies.
Figure 12E:
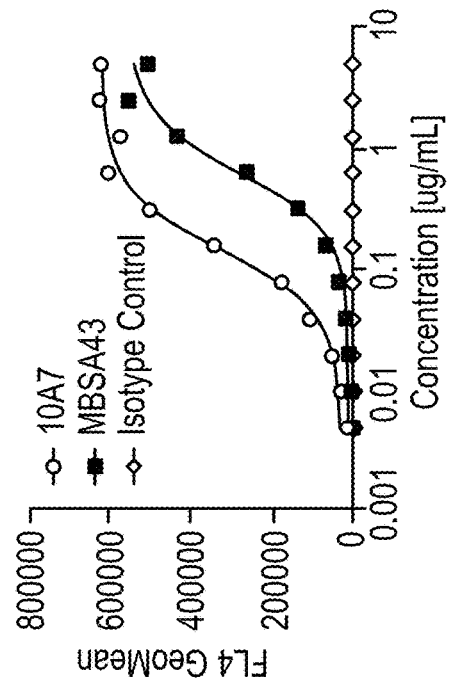
FIG. 12E is a graph of the binding of CD226-Fc in the presence of the indicated concentration of tool antibody or control antibody.
Figure 12D:
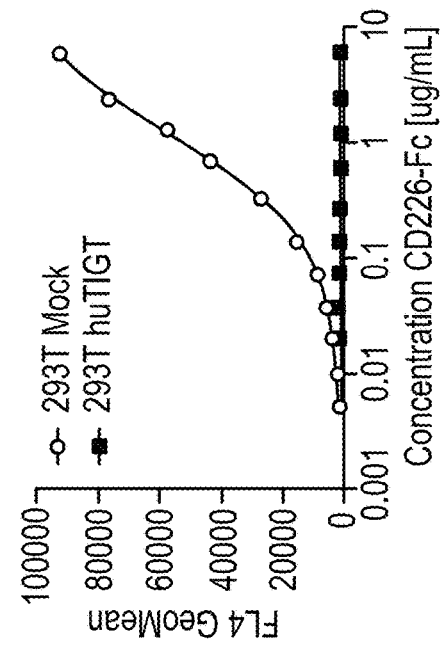
FIG. 12D is a graph of the binding of CD226-Fc to the different cells of FIG. 12C without any antibodies.

Additional binding assays were performed to determine whether tool TIGIT antibodies could inhibit the binding interactions between CD226 and CD155 endogenously expressed by 293T cells. 293T cells endogenously express high levels of CD155. The 293T cells were transiently transfected with human TIGIT (TIGIT-293 cells) or were mock transfected (Mock-293 or 293T Mock). In the absence of tool TIGIT antibodies, CD226 is blocked from binding to endogenous CD155 by TIGIT expressed by TIGIT-293 cells but not blocked in the context of Mock-293 cells (which do not transiently express TIGIT). In the presence of tool TIGIT antibodies, TIGIT expressed by TIGIT-293 cells is bound by tool antibodies and is blocked from binding to CD155, thereby allowing CD226 to interact with CD155. FIG. 12C provides a schematic of the assay. TIGIT-293 cells or Mock-293 cells were mixed with the antibody sample with and without human CD226-Fc at 10 ug/mL (R&D, 666-DN) and incubated for 1 hour at 4° C. in FACS Buffer (1×PBS pH7.4+2% Fetal Bovine Serum). Cells were washed 2× with FACS Buffer and then incubated with Gt anti Hu IgG-Fc Alexa (Jackson, 109-605-098) and 7-AAD (Sigma, 9400-5MG) for 15 minutes at 4° C. Cells were washed 1× with FACS Buffer and resuspended in FACS buffer. Samples were analyzed using a BD Accuri™ Flow Cytometer and an Intellicyt HyperCyt autoSampler. The results are shown in FIGS. 12D-12E. The data in FIG. 12D demonstrates that huCD226 can bind 293T Mock cells (open circles) endogenously expressing huCD155. In the presence of overexpressed huTIGIT (closed squares), CD226 binding is blocked from cis-interaction with huCD155. FIG. 12E shows that treatment with TIGIT tool antibodies 10A7 (open circles) or MBSA43 (closed squares) restore the ability of CD226 to bind to CD155, as the tool antibodies block TIGIT-CD155 cis-interactions. Treatment of cells with an irrelevant isotype control (half open diamonds) was included to demonstrate a complete blockade of CD226 binding to CD155 (given that the isotype control did not bind to TIGIT). The data support that both tool TIGIT antibodies interrupt CD155-TIGIT interactions, and that the 10A7 tool antibody was better at interrupting the TIGIT-CD155 interactions.

Figure 12F:
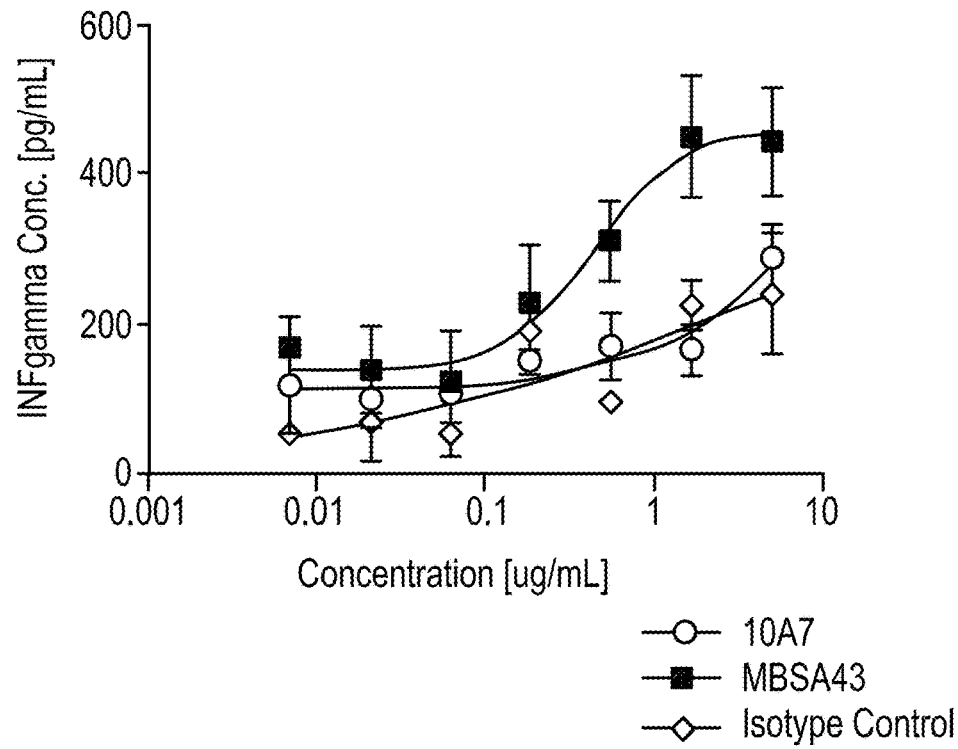
FIG. 12F is a graph of the concentration of IFNγ made by T-cells in the presence of the indicated concentration of tool antibody or control antibody.

IFN release assays were carried out to determine the functional effects of the tool TIGIT antibodies. In the IFN release assays, IFNγ released by primary human CD8+ memory T-cells stimulated with CHO-K1-huCD155 activator cells was measured. The results, shown in FIG. 12F, demonstrate that only the MBSA43 tool antibody was able to induce IFNγ release. Unlike MBSA43, the 10A7 antibody was unable activate IFNγ release by stimulated T cells.

Figure 12G:
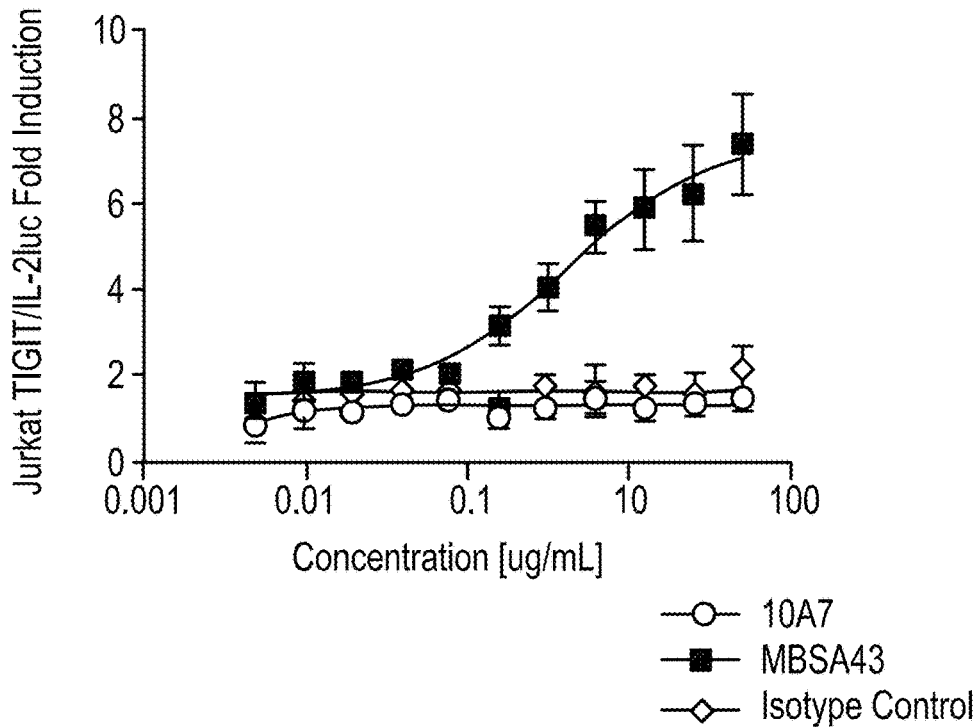
FIG. 12G is a graph of the concentration of NFAT luciferase activity induced in the presence of the indicated concentration of tool antibody or control antibody.

Luciferase activity assays under the control of the IL-2 promoter were also performed to determine the functional effects of the tool TIGIT antibodies. Jurkat T cells were stimulated for IL-2 promoter—driven expression of the luciferase reporter gene in the presence of tool antibodies or an isotype matched antibody control by CHO cells expressing human CD155 and a CD3-activator. The results, shown in FIG. 12G, are consistent with the results of FIG. 12F in that only the MBSA43 tool antibody was able to bind to TIGIT and block CD155-TIGIT interactions, leading to restored T-cell activation-induced events (e.g., IFN release, activation of IL-2 promoter).

These results demonstrate that both tool TIGIT antibodies MBSA43 and 10A7 could bind to TIGIT and block TIGIT-CD155 cis interactions, but only the MBSA43 tool antibody was able to block the TIGIT-mediated T-cell suppression.

Tool TIGIT antibodies were tested for their ability to bind cyno TIGIT using primary cyno monkey T-cells and cyno TIGIT transiently expressed on CHO and 293T cells. 293T cells transiently expressing cyno TIGIT or vector alone were mixed with a sample comprising tool antibody MBSA43, 10A7 or 1F4 (Genentech TIGIT antibody) and incubated for 1 hour at 4° C. in FACS Buffer. Cells were washed 2× with FACS buffer and then incubated with goat (Gt) anti Hu IgG-Fc Alexa-647 or Gt anti Mu IgG-Fc Alexa-647 (Jackson 115-605-071) and 7-AAD for 15 minutes at 4° C. Cells were washed 1× with FACS buffer and resuspended in FACS buffer. Samples were analyzed using a BD Accuri™ Flow Cytometer and an Intellicyt HyperCyt autoSampler.

Figure 12H:
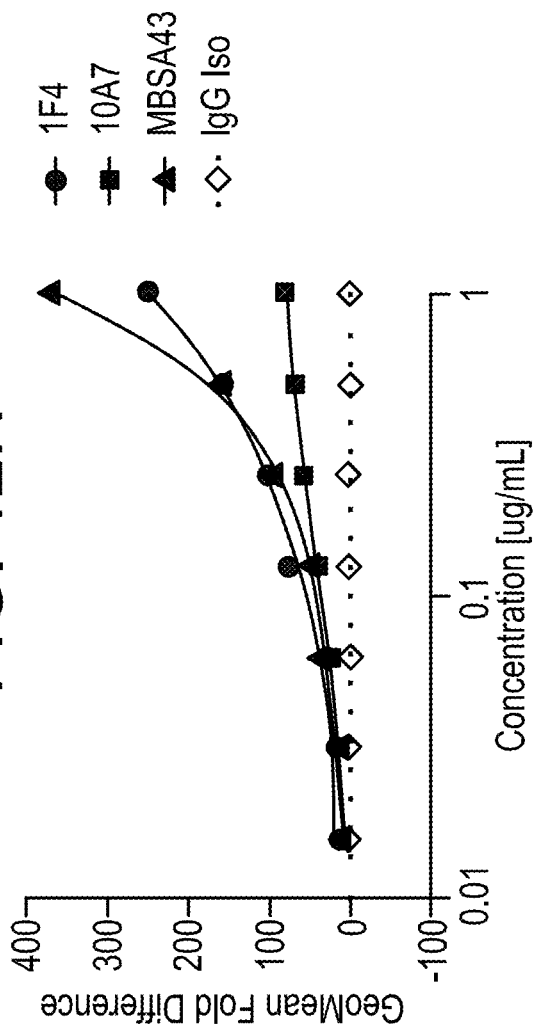
FIG. 12H is a graph of the binding in the presence of the indicated concentration of tool antibody or control antibody. 1F4 is a tool antibody like 10A7 and MBSA43.
Figure 12I:
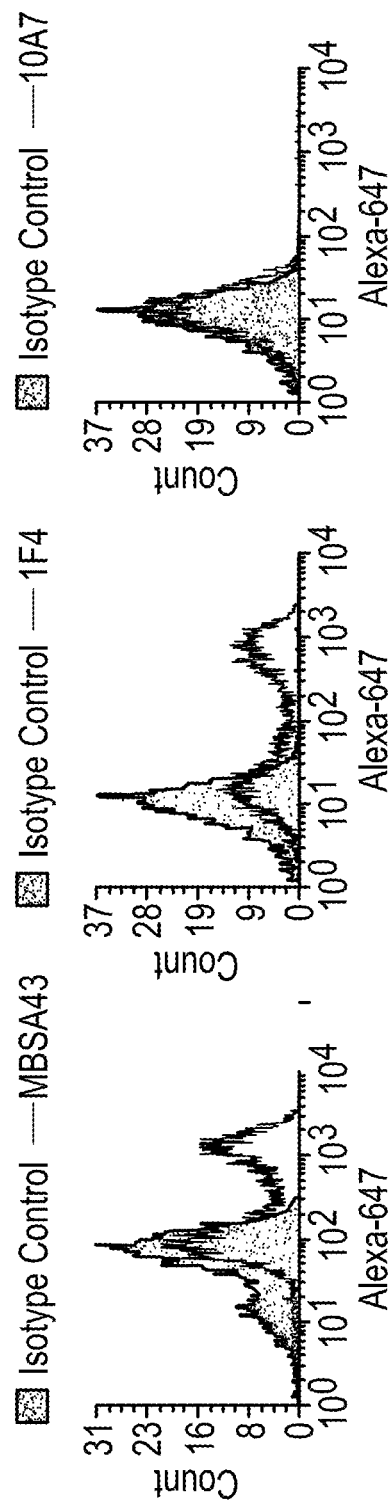
FIG. 12I is a series of plots demonstrating the binding activity of the indicated antibody to primary pre-activated cyno T-cells relative to isotype control.

The results are shown in FIGS. 12H and 12I. FIG. 12H shows that each of 1F4 (closed circles), 10A7 (closed squares) and MBSA43 (closed triangles) binds cyno TIGIT transiently expressed in 293T cells. An increase in GeoMean fold difference from the vector alone control is observed with increasing antibody concentration while no binding is seen with the IgG isotype control (open diamonds). However, only MBSA43 and 1F4 demonstrated binding to primary activated cyno T-cells (FIG. 12I). The FACS plot for 10A7 overlapped with the FACS plot for an isotype control antibody suggesting that 10A7 does not bind to primary activated cyno T-cells (FIG. 12I).

Example 5

This example demonstrates the generation of TIGIT monoclonal antibodies (mAbs).

Generation of anti-TIGIT Immune Responses

Mouse Strains and Immunizations

Fully human antibodies to human TIGIT were generated by immunizing XENOMOUSE® transgenic as essentially described above. Animals from the XMG4 and XMG2 XENOMOUSE® strains were used for these immunizations. Multiple immunogens and routes of immunization were used to generate anti-human TIGIT immune responses. TIGIT-specific serum titers were monitored by live-cell FACS analysis on an Accuri flow cytometer (BD Biosciences) using transiently transfected suspension CHO cells. Animals with the highest antigen-specific serum titers against human TIGIT were sacrificed and used for hybridoma generation (Kohler and Milstein, 1975). Hybridomas were generated as essentially described in Example 3.

Selection of TIGIT Specific Binding Antibodies

Figure 13:
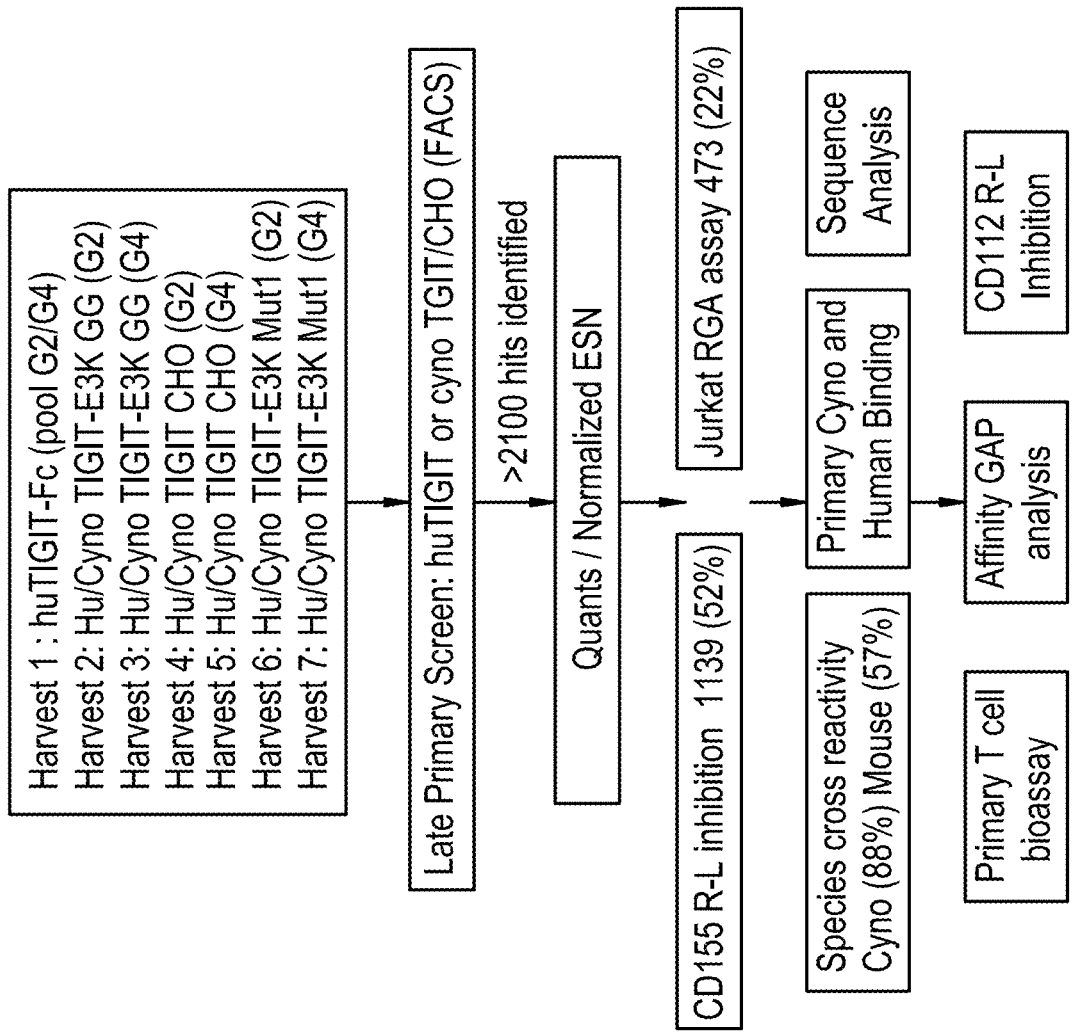
FIG. 13 is a schematic of the screening assays utilized to discover anti-TIGIT antibodies.

Several screening assays were employed to identify and select anti-human TIGIT antibodies (FIG. 13).

TIGIT-specific serum titers were monitored by live-cell FACS analysis. Exhausted hybridoma supernatants were tested for binding to human or cyno TIGIT transiently expressed on CHO-S samples and analyzed using a BD Accuri™ Flow Cytometer and an Intellicyt HyperCyt autosampler or by Cell Insight. For FACS based screens, CHO-S cells were transiently transfected with a mammalian expression construct encoding either human or cynomolgus TIGIT using PEI MAX. 3 hours post transfection, 5 mM sodium butyrate was added and incubated for 24 hours. The following day, 15 µL of exhausted hybridoma media was added to each well of a 384 well FMAT plate. Transfected and mock transfected CHO-S cells (25,000 cells/well total), were mixed with the exhausted hybridoma sample and incubated for 1 hour at 4° C. in FACS Buffer. After 1 hour, cells were washed 2× with FACS Buffer (1×PBS pH7.4+2% FBS) and then incubated with Gt anti Hu IgG-Fc Alexa-647 (Jackson, 109-605-098) or Gt anti Mu IgG-Fc Alexa-647 (Jackson 115-605-071) and 7-AAD (Sigma, 9400-5MG) for 15 minutes at 4° C. Cells were washed 1× with FACS Buffer and resuspended in FACS buffer. Samples were analyzed using a BD Accuri™ Flow Cytometer and an Intellicyt HyperCyt autosampler. For imaging screens, CHO-S or HEK293T cells were transiently transfected with a mammalian expression construct encoding TIGIT using PEI MAX or 293Fectin respectively. The following day, 15 µL of exhausted hybridoma media was added to each well of a 384 well FMAT plate. The transfected cells (0.27 million/mL), the nuclear stain Hoechst 33342 (7.5 µg/mL) and a secondary detection antibody (0.75 µg/mL—Goat anti Human IgG (H+L) Alexa 488 (Jackson ImmunoResearch)) were mixed and 30 µL of this mixture was added to each well of a 384 well FMAT plate. After ~3 hours, the supernatant was aspirated using an AquaMax plate reader and 30 µL of FACS buffer was added to each well using a multidrop instrument. The plates were placed on a Big Bear Plate shaker to evenly distribute the cells in the well and then read on the Cell Insight platform using the Cell Health Bio-App.

Using these techniques, hybridoma cells producing antibody specific to human TIGIT were identified as outlined in Table 6.

TABLE 6

| Harvest | Antigen-specific binders |
|---|---|
| 1 | 89 |
| 2 | 288 |
| 4 | 904 |
| 5 | 708 |
| 6 | 608 |
| 7 | 684 |

Jurkat Human TIGIT/IL-2-Luciferase Reporter Gene Assay (RGA)

Figure 14A:
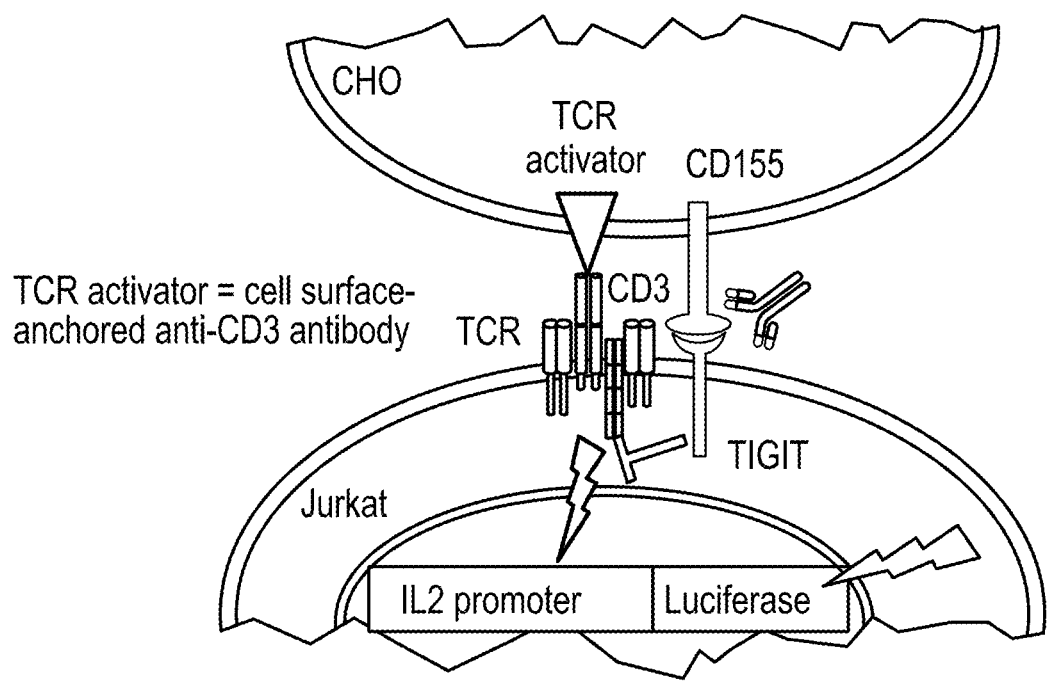
FIG. 14A is schematic of the Jurkat reporter gene assay (RGA). CHO cells expressing CD3 engager and CD155 are co-cultured with Jurkat T-cells expressing an NFAT-luciferase construct and TIGIT in the presence of antibodies or controls.

To screen for hybridomas or purified anti-TIGIT antibodies capable of enhancing T-cell activity by blocking TIGIT-CD155 interaction, an IL-2 reporter gene assay (RGA) in Jurkat cells was employed. The RGA was very similar to that described in Example 2, except that Jurkat cells stably expressing human TIGIT (not CD112R) and IL-2-luciferse reporter (Promega cat #CS191103A) were cultured in RPMI 1640 medium (Sigma) supplemented with 10% fetal bovine serum (Sigma), 2 mM L-glutamine (Sigma), 10 mM HEPES (Hyclone, GE Healthcare Life Sciences), 1×MEM NEAA (Sigma), 1× sodium pyruvate (Sigma), 500 ug/mL geneticin (Invitrogen) and 200 ug/mL hygromycin B (Invitrogen). The GloResponse™ IL-2-luc2P/TIGIT/Jurkat reporter cell line (Promega cat #CS191104A) was stimulated by engagement of T-cell receptor by co-culturing with Chinse Hamster Ovary (CHO)-K1 cells stably expressing human CD155 and human T-cell engager (Promega cat #CS191104A). 1×10E4 CHO-K1-CD155+ cells were seeded into white half area 96-well plates (Costar cat #3688) in full growth media containing Nutrient Mixture F12 HAM (Sigma), 10% fetal bovine serum, 10 mM HEPES, 500 µg/mL geneticin and 200 µg/mL hygromycin B overnight at 37° C./5% $CO_2$. FIG. 14A shows a schematic of the RGA. Following overnight incubation, growth media was replaced by $5×10^4$ Jurkat IL-2Luc/TIGIT cells in the presence of hybridoma supernatants or antibodies, with respective controls, in Assay Media (RPMI 1640 medium supplemented with 1% fetal bovine serum, 2 mM L-glutamine, 10 mM HEPES) and incubated at 37° C./5% $CO_2$ for 18 hrs. Reporter signal in each well was determined using Bio-Glo™ Luciferase Assay System (Promega cat #G7940) according to the manufacturer's recommendation. Luminescence was detected using EnVision Plate Reader (Perkin Elmer).

Figure 14B:
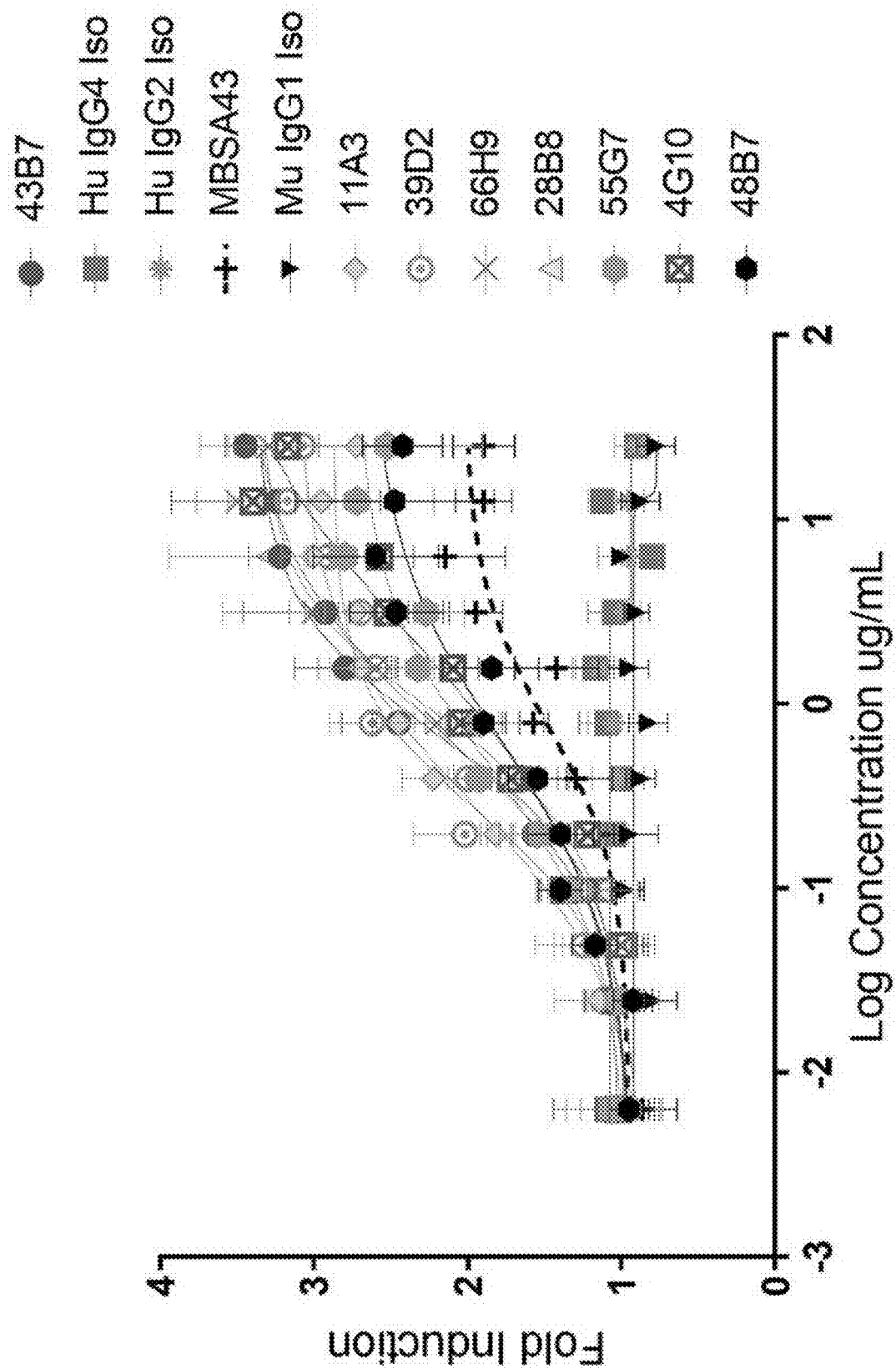
FIG. 14B is a graph of the NFAT-luciferase activity induced in the presence of the indicated TIGIT antibody or tool antibody (MBSA43) or control antibody (human IgG4 isotype control, human IgG2 isotype control, murine IgG1 isotype control).

A selection of active antibodies is shown in FIG. 14B. As shown in FIG. 14B, TIGIT antibodies 43B7, 11A3, 39D2, 66H9, 28B8, 55G7, 4G10, and 48B7 performed better than tool antibody MBSA43. These antibodies were run with titrations to determine the potency of anti-TIGIT antibodies. The activity of these anti-TIGIT antibodies in the Jurkat human TIGIT/IL-2-luciferase RGA is shown in Table 7.

TABLE 7

| | Potency [nM] | |
|---|---|---|
| Ab ID | n = 1 | n = 2 |
| 11A3 | 1.9 | 2.7 |
| 4G10 | 6.7 | 15.0 |
| 39D2 | 2.0 | 2.8 |
| 43B7 | 3.4 | 2.5 |
| 28B8 | 4.3 | 2.1 |
| 48B7 | 7.9 | 2.9 |
| 55G7 | 4.4 | 14.4 |
| 66H9 | 3.4 | 5.8 |

TIGIT Functional Blocking Assay (Primary T-Cell Assay)

To screen purified anti-TIGIT antibodies capable of enhancing T-cell activity by blocking TIGIT-CD155 interaction, IFN-γ release from primary human CD8 memory T-cells was employed. CD8 memory T-cells were isolated using EasySep™ HumanCD8+ve MEMORY T-cell Enrichment Kit (StemCell cat #19159) from purified primary human T-cells (Biological Specialty Corp. cat #215-01-10) and pre-stimulated with 1 µg/mL immobilized anti CD3 (eBioscience cat #16-0037)+1 µg/ml anti CD28 (BD PharMingen cat #555725)+10 ng/mL rhIL-2 (R & D Systems cat #202-IL-050/CF) for 7 days at 37° C./5% CO2). $1×10^4$ gamma irradiated CHO-K1-CD155$^+$ cells were seeded into black half area 96-well plates (Costar cat #3875) in full growth media overnight at 37° C./5% CO2. Following overnight incubation, growth media was replaced by $5×10^3$ CD8 memory T-cells in the presence of serially diluted antibodies, with respective controls, in ICM (Immune Cell Media: RPMI 1640, 10% fetal bovine serum, 10 mM HEPES, 2 mM L-glutamine, 1×MEM NEAA, 1× sodium pyruvate and 55 mM 2-mercaptoethanol (Gibco)) and incubated at 37° C./5% $CO_2$ for 48 hrs. Culture supernatants were then tested for IFN-γ level by Homogeneous Time-Resolved Fluorescence (HTRF) according to the manufacturer's instructions (Cisbio cat #62IFNPEC). Fluorescence was detected using EnVision Plate Reader (Perkin Elmer).

Figure 14C:
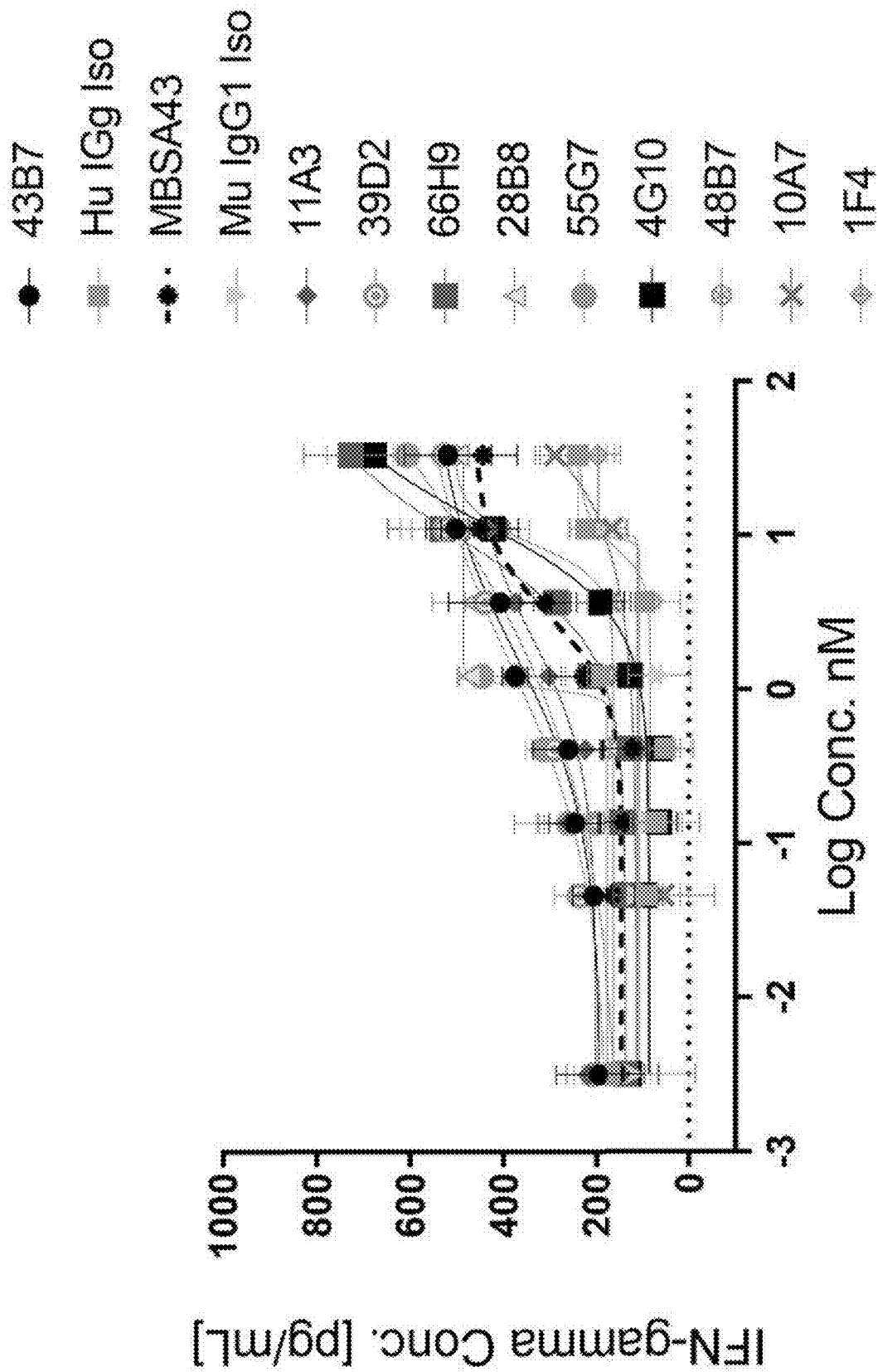
FIG. 14C is a graph of the IFNγ made by T-cells in the presence of the indicated TIGIT antibody or tool antibody (MBSA43) or control antibody (human IgG isotype control, murine IgG1 isotype control).

The results are shown in FIG. 14C. Anti-TIGIT antibodies performed similarly to or better than tool antibody MBSA43. The activity of anti-TIGIT antibodies 39D2, 43B7, and 28B8 in the primary CD8 memory T-cell assay was 380 pM, 90 pM, and 160 pM, respectively. The tool TIGIT antibody MBSA43 was run as a control and the potency of this tool antibody was 1900 pM.

Primary Cell Binding Assays for TIGIT

The binding of hybridoma supernatants to TIGIT expressed by primary human and cynomolgus monkey cells were tested by flow cytometry. For human primary cell binding assay, purified human T cells (Biological Specialty Corp.) were thawed and suspended at a concentration of $2.5 \times 10^6$ cells/mL. T cells were stimulated with 5 µg/mL of anti-human CD3 clone OKT3 (eBioscience) and 1 µg/mL of anti-human CD28 (BD Pharmingen) for 72 hours at 37° C./5% $CO_2$ in a plate that had been pre-coated with 5 µg/mL anti mouse IgG Fc (Pierce). After 72 hours, cells were removed, washed and suspended at a concentration of $0.5 \times 10^6$ cells/mL with 10 ng/mL of IL-2 (Pepro Tech). Cells were then incubated for another 48 to 72 hours at 37° C./5% $CO_2$. For cynomolgus primary cell binding assay, cynomolgus PBMCs (SNBL) were thawed and suspended in a concentration between $4 \times 10^6$ and $5 \times 10^6$ cells/mL. PBMCs were stimulated with 1 µg/mL of anti-human CD3 clone SP34 (BD Pharmingen) and 1 µg/mL of anti-human CD28 (BD Pharmingen) for 72 hours at 37° C./5% $CO_2$ in a plate that had been pre-coated with 5 µg/mL anti-mouse IgG Fc (Pierce). After 72 hours, cells were removed, washed and suspended at a concentration of 0.5×10E6 cells/mL with 20 ng/mL of IL-2 (Pepro Tech). Cells were then incubated for another 48 to 72 hours at 37° C./5% $CO_2$. After the final incubation, cells were prepared for flow cytometry by incubation with normalized hybridoma supernatants, positive control antibodies and isotype control antibodies at 1 µg/mL final concentration. Alexa Fluor 647 AffiniPure F(ab')² Fragment Goat Anti-Human IgG (H+L) (Jackson ImmunoReserach) at 5 µg/mL was used for secondary detection and 8.25 nM YoPro1 (Invitrogen) was used for a live/dead cell stain. Cells were then run on BD FACSCanto II flow cytometer to detect anti-TIGIT antibody binding. The results are expressed as FACS geomean fold of TIGIT expressing cells over geomean of isotype controls and "Yes" or "No" for binding (Table 8).

TABLE 8

| Antibody ID | Primary Cyno (FACS Geomean Fold)/Binder | Primary Human (FACS Geomean Fold)/Binder |
| --- | --- | --- |
| 11A3 | 1.0/No | 11.6/Yes |
| 4G10 | 1.2/No | 13.5/Yes |
| 39D2 | 1.4/No | 13.7/Yes |
| 43B7 | 4.7/Yes | 13.7/Yes |
| 28B8 | 0.90/No | 14.4/Yes |
| 48B7 | 7.2/Yes | 4.5/Yes |
| 55G7 | 12.3/Yes | 4.5/Yes |
| 66H9 | 4.0/Yes | 4.1/Yes |

As shown in Table 8, only four antibodies (43B7, 48B7, 55G7, and 66H9) were binders to both primary cyno and primary human cells.

Receptor-Ligand Competition Assay

TIGIT-binding hybridoma supernatants were then tested for their ability to block TIGIT from binding ligand. Competitive binding assays were performed on the antigen-specific hybridoma supernatant samples using FACS on CHO-s cells transiently expressing human TIGIT as follows. CHO-S cells expressing human TIGIT were mixed with the antibody sample (hybridoma supernatants specific for TIGIT) and incubated for 1 hour at 4° C., and then washed twice. Cells with bound sample were then incubated with huCD155-Fc-Alexa 647 (generated & labelled in house) or CD112-Fc-Alexa 647 (Sino Biological 10005-H02H; labelled in house) for 45 minutes at 4° C. The 7-AAD cell viability stain was then added and the cells incubated for a further 15 minutes at 4° C., washed twice and resuspended in FACS buffer. Samples were analyzed using a BD Accuri™ Flow Cytometer and an Intellicyt HyperCyt autoSampler. The data in the Table 9 reflects that percent inhibition of human CD155 or CD112 binding to human TIGIT at 1.7 µg/mL or 1 ug/mL respectively.

TABLE 9

| Antibody ID | CD155 Receptor - Ligand assay (% inhibition) | CD112 Receptor - Ligand assay (% inhibition) |
| --- | --- | --- |
| 11A3 | 100 | 100 |
| 4G10 | 100 | 91 |
| 39D2 | 100 | 100 |
| 43B7 | 100 | 100 |
| 28B8 | 100 | 97 |
| 48B7 | 99 | 88 |
| 55G7 | 99 | 86 |
| 66H9 | 98 | 85 |

TIGIT Affinity Determination

Affinity determination of anti-TIGIT mAbs was performed using an OCTET biosensor.

Human TIGIT mAbs were captured on anti-huIgG FC Capture (AHC) tips for kinetics (Cat #18-5060) at 2 µg/mL. Mouse anti-TIGIT control mAb MBSA43 (Cat #16-9500-85) was captured on anti-mouse IgG Fc Capture tips at 2 µg/ml. Binding of both the huTIGIT (PL44403) and cyno-TIGIT (PL40461) was assessed by titrating the proteins 2-fold from either 200 nM or 100 nM starting concentration down to 3 nM. Because the huTIGIT contains a mono-Fc tag, a blocking step containing 50 µg/ml irrelevant IgG2 was utilized to block the anti-Fc capture reagent on the Octet tips. For the huTIGIT affinity determination, association was monitored for 5 min with dissociation being monitored for 20 min. In the case of cynoTIGIT, association was monitored for 5 min and dissociation for 5 min. The assay buffer used in these experiments was 10 mM Tris, 150 mM NaCL, 1 mM $CaCl_2$, 0.1 mg/ml Bovine Serum Albumin (BSA), 0.13% Triton X-100, pH 7.6. The data in Table 10 represents the relative affinities of TIGIT mAbs to human or cynomolgus TIGIT. Due to very poor fits, no values were provided on cynoTIGIT for 2 mAbs. The limit of detection of dissociation is 4e-5 based on a minimum of 5% dissociation over 20 minutes.

TABLE 10

| Antibody ID | Affinity to Human TIGIT | Affinity to Cyno TIGIT |
| --- | --- | --- |
| 11A3 | <100 pM | NB |
| 4G10 | <200 pM | 39 nM |
| 39D2 | <100 pM | 43 nM |

TABLE 10-continued

| Antibody ID | Affinity to Human TIGIT | Affinity to Cyno TIGIT |
|---|---|---|
| 43B7 | <100 pM | 13 nM |
| 28B8 | <100 pM | NB |
| 48B7 | <100 pM | 38 nM |
| 55G7 | <100 pM | 17 nM |
| 66H9 | <100 pM | 18 nM |
| MBSA43 | <200 pM | <100 pM |

NB = No Binding

As shown in Table 10, each of the antibodies exhibited high affinity for human TIGIT and most demonstrated high affinity for cyno TIGIT.

Selection of TIGIT Antibodies

The results of the screening assays described above and in FIG. 13 led to the identification of less than 10 unique antibodies including 4G10, 11A3, 28B8, 43B7, 66H9, 39D2, and 55G7. Such antibodies demonstrated antagonist function as determined by the Jurkat RGA and antigen binding activity as determined by the human and cyno primary cell binding assays and thus these antibodies were moved forward to subsequent characterization screens, sequencing, and affinity determination. These TIGIT antibodies were among those that performed better than tool TIGIT antibodies MBSA43 and 10A7. A comparison of the selected TIGIT antibodies and tool antibodies is provided in Table 11. As shown in this table and as supported by FIGS. 14A and 14B, the selected TIGIT antibodies exhibited better activity compared to tool antibodies.

TABLE 11

|  | MBSA43 | 10A7 | Selected TIGIT antibodies |
|---|---|---|---|
| CD155 Blocker | Yes | Yes | Yes |
| CD112 Blocker | Yes | Yes | Yes |
| Active in Jurkat RGA | Yes | No | Yes* |
| Active in CD8 Memory T cell assay | Yes | No | Yes* |
| Primary Human TIGIT Binder | Yes | Yes | Yes |
| Primary Cyno TIGIT Binder | Yes | No | Yes* |

*activity better than tool antibody MBSA43

Molecular Rescue and Sequencing of TIGIT Antibodies

Molecular sequencing of the heavy and light chains of select TIGIT antibodies was performed as essentially described in Example 3, except that RNA (total or mRNA) was purified from wells containing the TIGIT antagonist antibody-producing hybridoma cells.

Hotspot Engineering of TIGIT Antibodies

Select anti-TIGIT antibodies from the XenoMouse campaign were engineered to remove "hotspots," or residues that were computationally predicted or empirically determined to negatively impact the molecule's expression, purification, thermal stability, colloidal stability, long-term storage stability, in vivo pharmacokinetics, and/or immunogenicity, as essentially described in Example 3.

Hotspot engineered variants were cloned, expressed transiently by co-transfecting HCs and LCs in ExpiCHO cells (Life Technologies) and were purified by Protein A affinity chromatography. Antibody activity was measured by the TIGIT Jurkat reporter gene assay as described above. The results of the analyses for engineered variants are shown below in Table 12.

Framework Grafting of TIGIT Antibodies

Anti-TIGIT antibodies 55G7.041 (comprising LC variable region sequence and HC variable region sequence of SEQ ID NOs 1923 and 1924, respectively), 66H9.009 (comprising HC variable region sequence and LC variable region sequence of SEQ ID NOs 221 and 222, respectively), 43B7.002.015 (comprising HC variable region sequence and LC variable region sequence of SEQ ID NOs 201 and 202, respectively) and 58A7.003.008 (comprising HC variable region sequence and LC variable region sequence of SEQ ID NOs 211 and 212, respectively) were engineered for improved manufacturability by grafting the CDRs of each antibody into selected alternate human frameworks with a preference for well-behaved VH1, VH3, VH5, VK1, VK3, and VL2 germlines. The alternate frameworks for each parent were selected by considering sequence similarity. In each case the pre- and post-graft sequences were carefully examined, especially at the graft junctions, and in some cases targeted backmutations were designed to provide the best chance of retaining functional conformation of the CDR loops.

Framework engineered variants were cloned by ordering synthetic DNA fragments comprising the designed variable domains and inserting these using Golden Gate cloning methods into a stable mammalian expression vector containing the constant HC or LC domains. Antibodies were expressed by co-transfecting HCs and LCs in CHO-K1 cells and purified by Protein A affinity chromatography using MabSelect SuRe resin (GE Healthcare Life Sciences). The identity of each variant was confirmed by intact mass spectrometry. For each variant, the expression titer in conditioned medium was measured by ForteBio Octet (Pall Life Sciences) using Protein A sensors. The percent of high molecular weight (% HMW) material present after Protein A affinity chromatography was measured by analytical size exclusion chromatography, and the purity was measured by % main peak in non-reduced microcapillary electrophoresis using a LabChip GXII (Perkin Elmer). The Tm of the first melting transition was measured by DSF using a Prometheus (Nanotemper). Purified samples were incubated at 40° C. for 2 weeks and the change in % main peak was determined by analytical size exclusion chromatography. Antibody activity was measured by the TIGIT Jurkat reporter gene assay as described above, averaging two independent measurements. The results of the analyses for engineered variants are shown below in Table 13.

Yeast Display Optimization of TIGIT Antibodies

Anti TIGIT antibodies 43B7.002.015 (comprising HC variable region sequence and LC variable region sequence of SEQ ID NOs 201 and 202, respectively) and 58A7.003.008 (comprising HC variable region sequence and LC variable region sequence of SEQ ID NOs 211 and 212, respectively) were engineered for improved manufacturability and for increased binding to TIGIT through yeast display. For each antibody, libraries were generated in which every possible adjacent pair of residues in the all six CDRs were simultaneously mutated to all possible amino acids through use of degenerate NNK codons. The libraries were displayed on the surface of yeast derivative of BJ5464, wherein the Fd domain was fused to the N-terminus of alpha-agglutin and the LC was not fused to the yeast surface. Efficiency of display was measured by binding of Alexafluor 647 conjugated anti-Fab antibody. Libraries were sorted using fluorescence activated cell sorting (FACS) for high binding to biotin conjugated recombinant TIGIT extracellular domain (ECD) using streptavidin PE as fluorescence secondary. The variable domains present in the sorted binding/display double positive pools and display positive pools were amplified with primers specific to the FW1 and FW4 domains of the HC and LC and submitted to NGS analysis on an Illumina MiSeq for a 2×300 bp run. Mutations were selected after processing the data through a common frequency analysis where the ratio of positive binding amino acid frequencies are divided by positive display amino acid frequencies which is then normalized to the parental sequence ratio. The sequences where the enrichment values were greater than or equal to the parental sequence were considered beneficial or tolerated diversity and were used for additional rational antibody engineering post affinity maturation.

Affinity maturation yeast display libraries for each HC and LC were designed using a combination of structure guided (58A7.003.008), model guided proximity pairs (43B7.002.015), and CDR NNK scanning libraries (43B7.002.015 and 58A7.003.008). After these HC or LC libraries were sorted for TIGIT binding equal to or greater than parental, the 4 libraries were combined in a chain shuffle library. Here all library designs were mixed together to be agnostic between design approaches. The libraries were displayed on the surface of yeast as described above and sorting for high binding to biotin-labeled recombinant TIGIT ECD with increased stringency in each consecutive round. Clones with high binding were selected and screened as individual clones and the clones with the highest ratios of binding/display were selected for sequencing. Variable domains were amplified using vector and constant domain primers and the PCR products were submitted for Sanger Sequencing. Sequences which introduced chemical liabilities were dropped from the panel design. Chemical liabilities and charge surface patches identified by the BioLuminate modeling suite (Schrödinger, LLC) were mutated using information from the NGS enrichment sort data described above. The final engineered sequences were selected for further characterization as recombinant expressed monoclonal antibodies.

Top display engineered variants were cloned by ordering synthetic DNA fragments comprising the designed variable domains and inserting these using Golden Gate cloning methods into a stable mammalian expression vector containing the constant HC domains under puromycin selection or the constant LC domains under hygromycin selection. Antibodies were expressed by co-transfecting HCs and LCs in CHO-K1 cells and selecting for stable expression using puromycin and hygromycin. Antibodies were purified by Protein A affinity chromatography using AmMag™ Protein A Magnetic Beads (GenScript). The identity of each molecule was confirmed by intact mass spectrometry. The percent of high molecular weight (% HMW) material present after Protein A affinity chromatography was measured by analytical size exclusion chromatography, and the purity was measured by % main peak in non-reduced microcapillary electrophoresis using a LabChip GXII (Perkin Elmer). Antibody activity was measured by the TIGIT Jurkat reporter gene assay as described above. The results of the analyses for engineered variants are shown below in Tables 14 and 15.

Function of Engineered TIGIT Antibodies and Tool Antibodies

Jurkat T-cells expressing TIGIT and an IL-2-Luciferase construct were modified using CRISPR to knock out (KO) CD226 expression. These KO cells were used in a Jurkat RGA and compared to CD226-expressing Jurkat cells expressing TIGIT and an IL-2-Luciferase construct. Jurkat cells were co-cultured with CHO-K1-CD155+ cells as described herein, and luciferase activity was measured. The antibodies used in this experiment included tool antibody MBSA43 and engineered TIGIT antibodies (as described above) AB1 (43B7.002.015) and AB2 (66H9.010).

Figure 15:
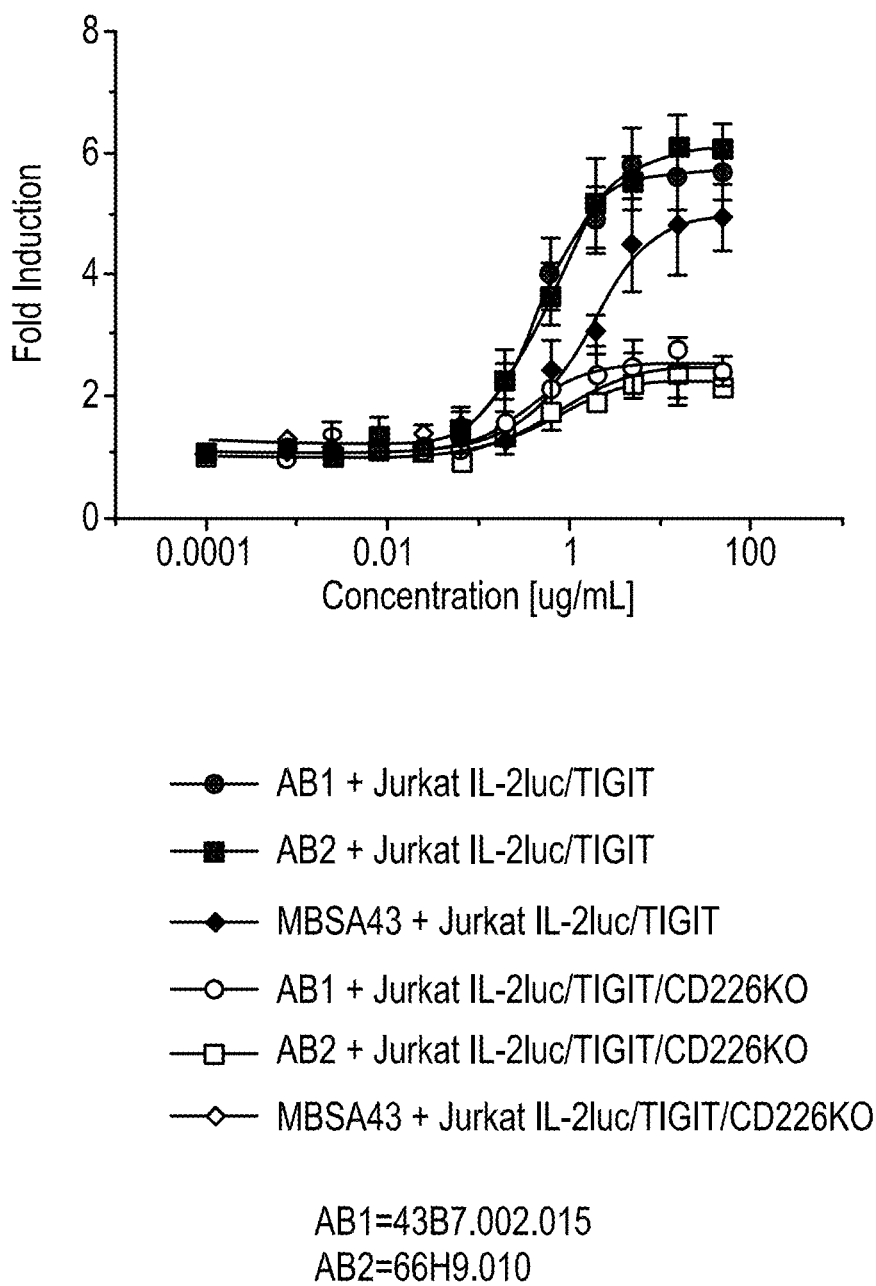
FIG. 15 is a graph of the luciferase activity induced in the presence of the indicated TIGIT antibody (AB1 or AB2) or tool antibody (MBSA43) by Jurkat T cells transfected with the IL-2-Luciferase reported construct and TIGIT. One set of cells was engineered to knock out CD226 expression (CD226KO).

The results are shown in FIG. 15. As shown in FIG. 15, knocking out CD266 resulted in a significant decrease in max activity (open symbols vs closed symbols). These data support that the TIGIT antibodies block TIGIT-CD226 cis interactions to prevent TIGIT-CD226-mediated signal suppression. These data also support that CD226 involvement contributes to a stronger TCR response. In the presence of CD226 Anti TIGIT mAbs AB1 and AB2 (closed circles and closes squares, respectively) block TIGIT-CD226 interactions better than MBSA43 (closed diamonds) as max activity is not completely reached. When CD226 is knocked out, AB1, AB2 and MABSA43 block TIGIT-CD155 interactions similarly.

Example 6

This example demonstrates the binding affinities of select antibodies of the present disclosure.

Binding of anti-TIGIT antibodies to human TIGIT SEQ ID NO: 1 and cynomolgus TIGIT SEQ ID NO: 2024, and binding of anti-CD112R antibodies to human CD112R SEQ ID NO: 3 and CD112R (N81D) SEQ ID NO: 2026 were characterized on Biacore T200 using Surface Plasmon Resonance (SPR) technology. In detail, an anti-human Fab antibody from Fab capture kit (GE Healthcare Life Sciences) was immobilized on all four flow cells of a CMS chip to approximately 6000-9000 RU using standard amine coupling reagents (GE Healthcare Life Sciences). PBS plus 0.005% P20 was used as instrument running buffer throughout the assays. The first flow cell with immobilized anti-human Fab antibody only was used as background control. Anti-TIGIT or anti-CD112R antibodies were captured on the second, third and fourth flow cells to approximately 100-190 RU. Human and cynomolgus TIGIT, human CD112R and CD112R (N81D), at concentration ranged from 0.78 to 100 nM, were diluted in sample buffer (PBS plus 0.1 mg/ml BSA, 0.005% P20) and injected over captured antibody surfaces for 180 seconds association, and 300 seconds dissociation at 50 µl/min. At the end of dissociation, the anti-Fab antibody surfaces were regenerated using 10 mM glycine, pH 2.1.

Binding data of anti-TIGIT antibodies to human and cynomolgus TIGIT, anti-CD112R antibodies to human CD112R and CD112R (N81D) were analyzed using Biacore T200 Evaluation Software 3.0 (GE Healthcare Life Sciences). All the data were double referenced by subtracting the blank control surface and the blank cycle injecting sample buffer only. For the binding of anti-TIGIT antibodies to human TIGIT, and anti-CD112R antibodies to human CD112R and CD112R (N81D), on rate (10, off rate ($k_d$), equilibrium dissociation constant ($K_D$) and maximum binding response ($R_{max}$) were calculated from global fitting using the 1:1 kinetic binding model. For the binding of anti-TIGIT antibodies to cynomolgus TIGIT, $K_D$ and $R_{max}$ were calculated from global fittings using the 1:1 steady state binding model. Human TIGIT binding characterization is shown in Table 16. Cynomolgus TIGIT binding characterization is shown in Table 17. Human CD112R binding data is shown in Table 18 and human CD112R (N81D) binding characterization is shown in Table 19.

Example 7

This example demonstrates that combination blockade of CD112R, TIGIT, and PD-1 increases the window of T cell response.

Figure 16A:
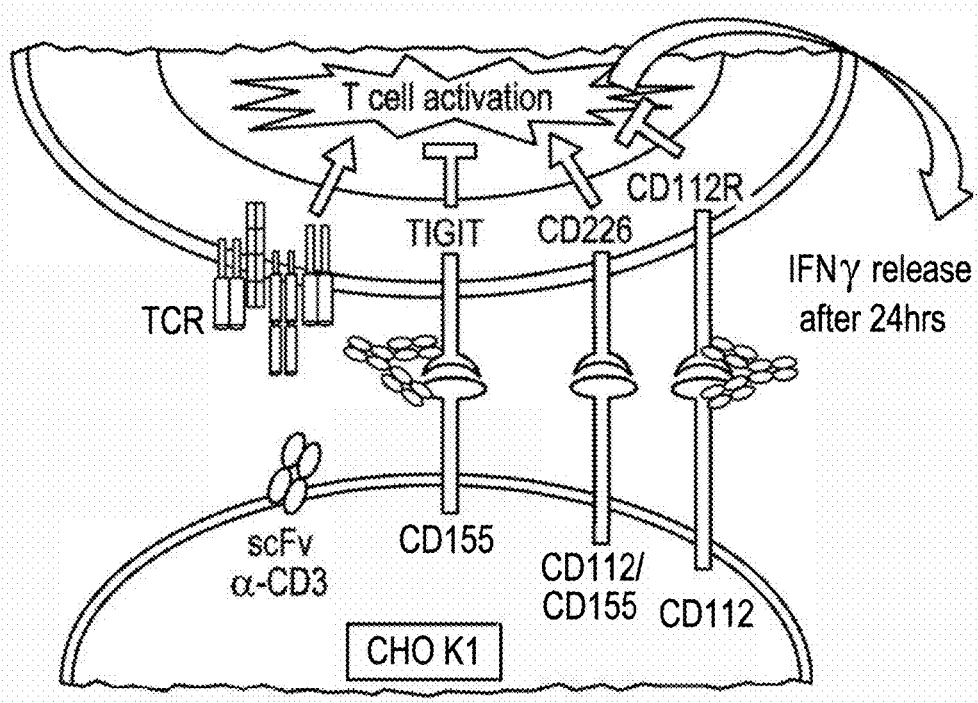
FIG. 16A is a schematic of an IFNγ release assay using T cells expressing TIGIT, CD226 and CD112R and CHO cells expressing CD155, CD112, and an scFV anti-CD3.
Figure 16B:
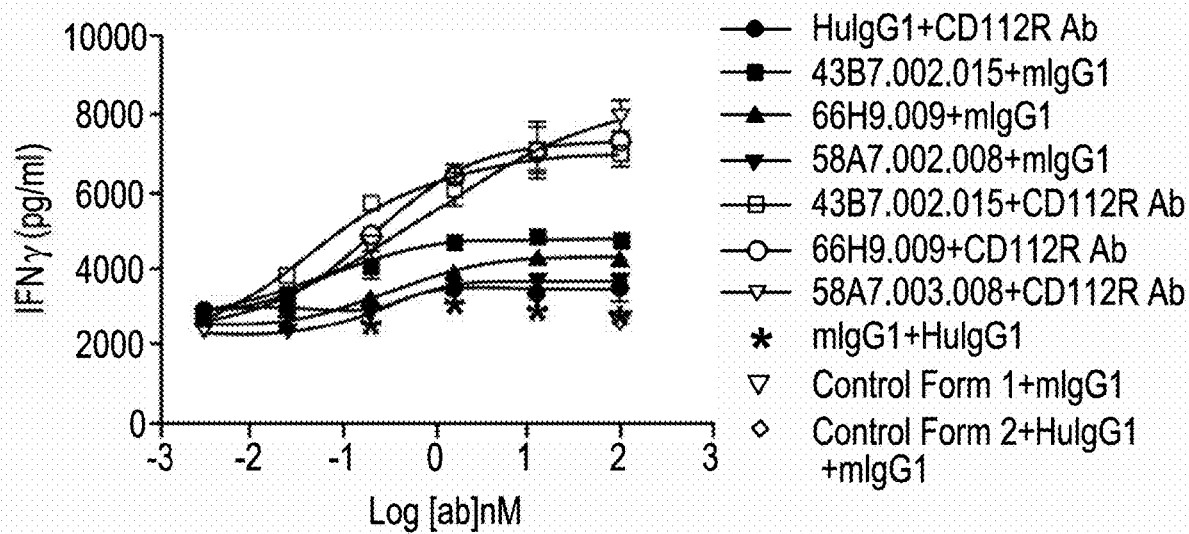
FIG. 16B is a graph of the IFNγ released in the presence of the indicated combinations of antibodies. HuIgG1 and mIgG1 are isotype matched control antibodies. Tool CD112R antibodies include PL-52577.

To evaluate the effects of CD112R and TIGIT combination blockade, CHO K1 cells that express both CD112 and CD155 were generated. The cells were contacted with T-cells and activation of the TCR of these cells was expected to lead to IFN gamma release only when the TIGIT-CD155 interaction and the CD112R-CD112 interaction were blocked. A schematic of the cell assay system is shown in FIG. 16A. Three different TIGIT antibodies (43B7.002.015, 66H9.009 and 58A7.002.008 were tested and demonstrated a mild effect as single agents, but when used in combination with a CD112R blocking antibody, T cell activity was strongly enhanced in this assay (FIG. 16B).

Furthermore, CD112R and TIGIT blockade by 1:1 antibody mixtures was compared to blockade by a bispecific antibody (bsAb) where both antibodies were present in an IgG-scFv format in this assay. The effects on T cell activity of the monoclonal antibody mixtures are shown in Table 20. These effects on T cell activity were comparable to those achieved with the bsAb, suggesting that these receptors independently contribute to T cell activation (data for bsAb not shown).

TABLE 20

| Antibody Clones of mAb Mixture | Average EC50 (nM) | Fold over Baseline at Max. |
| --- | --- | --- |
| 29E10 and 43B7.002.015 | 0.16 (±0.1) | 2.24 (±0.27) |
| 24F1 and 43B7.002.015 | 0.15 (±0.012) | 2.75 (±0.28) |
| 11E4 and 43B7.002.015 | 0.40 (±0.3) | 3.27 (±0.3) |

Standard Deviation provided in ( );
n = 3

Figure 17A:
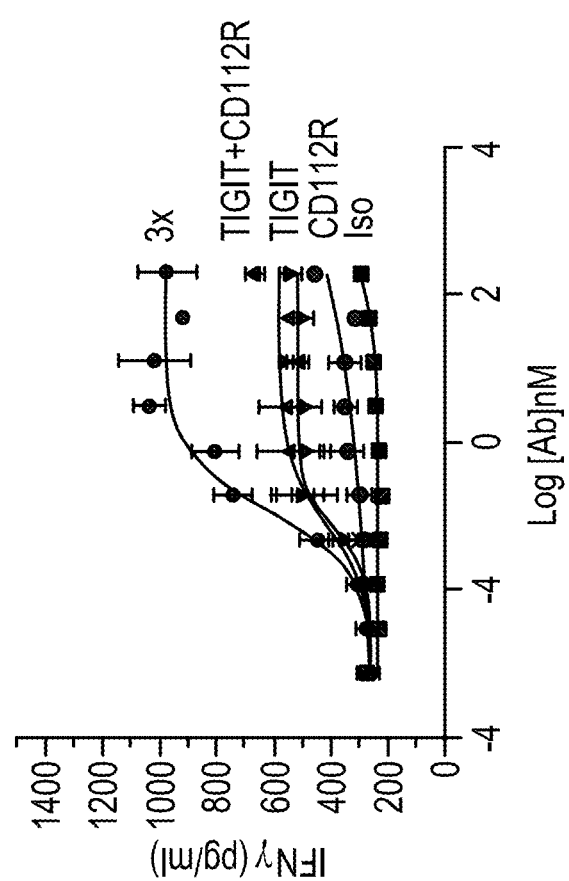
FIG. 17D is a graph of the expected vs. observed results of the IFNγ release assay for the indicated combination of antibodies or for the single antibody.
FIG. 17E is a graph of the IFNγ released in the presence of the indicated combinations of antibodies of 2 or three antibodies or single antibody in dissociated human tumor cell assay. IFNγ concentration of supernatant collected on Day 3 vs Day 6 is shown.
FIG. 17F is a graph of the % of cells positive for expression for indicated molecules in CD4 T cells in PBMC or tumor cells.
FIG. 17G is a graph of the % of cells positive for expression for indicated molecules in CD8 T cells in PBMC or tumor cells.
FIG. 17H is a graph of the % of cells positive for expression of PD-1 on Day 6 of dissociated tumor cell cultures wherein the cells were treated with anti-TIGIT antibody, anti-CD112R antibody or isotype control antibody.
FIG. 17I is a graph of the % of cells positive for expression of TIGIT on Day 6 of dissociated tumor cell cultures wherein the cells were treated with anti-PD-1 antibody, anti-CD112R antibody or isotype control antibody.
Figure 17B:
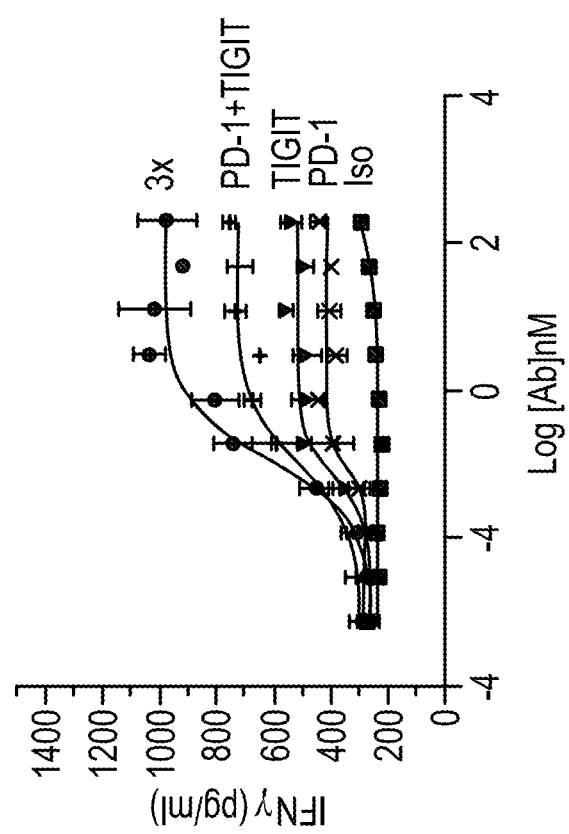

The activity of dual blockade of two of TIGIT, CD112R, and PD-1 compared to triple blockade (blockade of all three of TIGIT, CD112R, and PD-1) was evaluated in an antigen-specific CTL assay using peptide-pulsed SK-MEL tumor cells as the antigen presenting cells (APCs). The pp65 peptide-specific CU response to peptide-pulsed tumor cells for dual blockade of PD-1 and TIGIT, triple blockade (3×), single blockade of TIGIT, and single blockade of PD-1 is shown in FIG. 17A. The pp65 peptide-specific CU response to peptide-pulsed tumor cells for dual blockade of CD112R and TIGIT, triple blockade (3×), single blockade of TIGIT, and single blockade of CD112R is shown in FIG. 17B. The pp65 peptide-specific CU response to peptide-pulsed tumor cells for dual blockade of PD-1 and CD112R, triple blockade (3×), single blockade of CD112R, and single blockade of PD-1 is shown in FIG. 17C. Expected and observed outcomes are shown in FIG. 17D.

As shown in FIGS. 17A-17C, the pp65 peptide-specific CTL response to peptide-pulsed tumor cells was slightly enhanced with single blockade of TIGIT, CD112R, or PD-1 (relative to isotype control), and each case of dual blockade (TIGIT+CD112R, TIGIT+PD-1, CD112R+PD-1) further enhanced the pp65 peptide-specific CTL response. In each of FIGS. 17A-17C, triple blockade demonstrated the most significant increase in T cell activity against the tumor cells. Whether the responses of the different combinations represented strictly additive or synergistic effects were evaluated by comparing the calculated expected vs. observed enhancement window in this assay (FIG. 17D) and it was found that, while the effects of TIGIT+PD-1 or CD112R+PD-1 combo were additive, the effect of triple blockade of TIGIT+CD112R+PD-1 was synergistic (FIG. 17D).

Example 8

This example demonstrates that triple blockade enhances T/NK cell response in primary human tumor cell cultures.

The effect of single blockade, dual blockade and triple blockade on TILs was tested by treating dissociated human tumor cells (with accompanying TILs) with PD-1 antibody (Nivolumab "Nivo"), CD112R antibody (24F1), or TIGIT antibody (43B7.002.015), and combinations of two or three of these antibodies, and measuring TIL response as represented by IFNγ production. An isotype-matched antibody was used as a control. Measurements were taken on Days 3 and 6 and the results are shown in FIG. 17E.

Figure 17I:
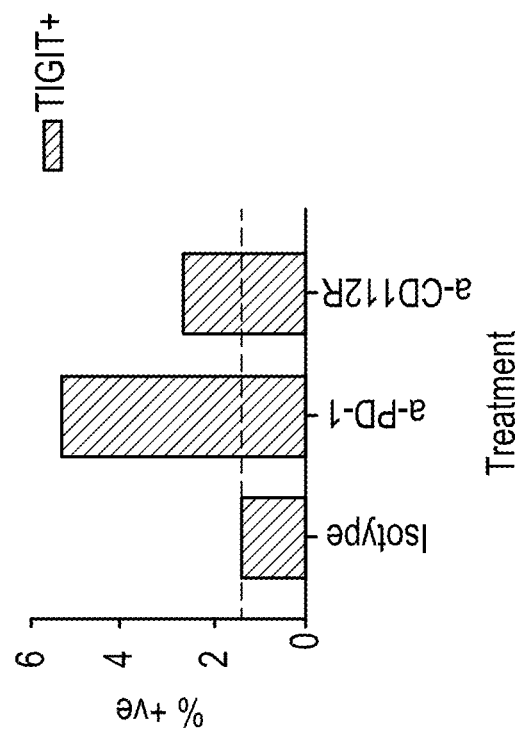
Figure 17H:
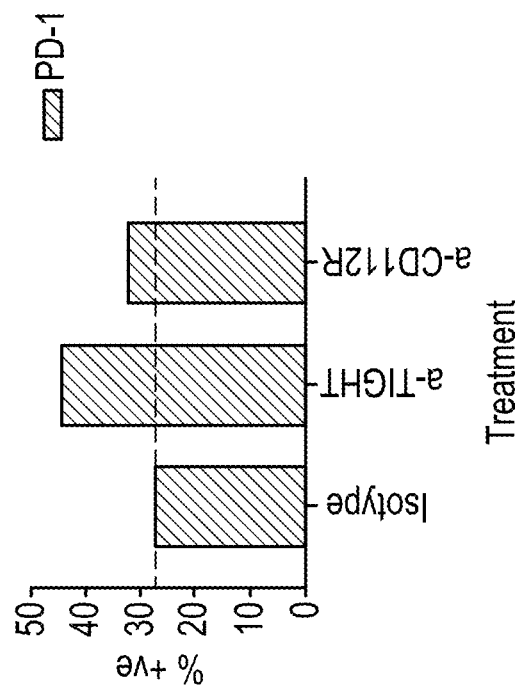

As shown in FIG. 17E, IFNγ production was greater on Day 3 compared to Day 6. Triple blockade with Nivo+43B7.002.015+24F1 antibodies induced the highest amounts of IFNγ production on both Days 3 and 6 compared to single blockade and dual blockade. These results suggest that in primary TILs expressing relatively low levels of these checkpoint receptors (FIGS. 17F and 17G), the triple combination treatment induced significant enhancement of TIL activity. Interestingly, it was observed that TILs that had been treated with a-PD-1 antibody had upregulated TIGIT expression (FIG. 17H), while those treated with α-TIGIT antibody had upregulated PD-1 by the end of the culture period (FIG. 17I). This expression profile is consistent with published reports on data from similar in vitro T cell assays and in patients treated with a-PD-1 suggesting that triple blockade will be effective to increase T-cell responses in patients.

Example 9

This example provides a discussion of the results from Examples 1, 2, 7, and 8.

CD112R and TIGIT primarily engage CD112 and CD155, respectively, and suppress T and NK cell response to tumor cells. We demonstrated that tumor cells express high levels of both ligands and therefore, inhibition of both CD112R and TIGIT is likely required for effective engagement of CD226, which enhances T/NK cell activity.

We developed a composition comprising co-formulated mixtures of monoclonal antibodies that simultaneously blocked CD112R and TIGIT. The composition performed as well as the two monoclonal antibodies formatted into a bispecific molecule. Both modalities significantly enhanced primary human T cell activity in in vitro assays and that the overall activities were comparable. In addition, triple blockade using the monoclonal CD112R and TIGIT antibodies in combination with PD-1 blocking antibody further enhanced T cell activity, better than any single or double combinations from the three.

CD112R and TIGIT co-blockade presents a promising approach for a combination treatment with PD-1/PD-L1, since triple blockade can engage two non-redundant costimulatory pathways to enhance T/NK cell activity. The result may be an increased efficacy window over PD-1/L1 monotherapy and importantly, a reduced likelihood of or overcoming tumor resistance to a monotherapy, as seen in PD-1/L1 refractory patients.

Example 10

This example describes the materials and methods used in the experiments of Examples 1-2 and 7-8.

TCGA Correlation Plot Generation in Array Studio

The log (FPKM) values representing transcript levels of genes of interest were extracted from the TCGA dataset and plotted in scatter plots to show pairwise correlation. The analysis was performed for TIGIT family receptors and PD-1 and their ligands for multiple cancer indications.

Single Cell RNA Sequence Data Analysis

Single cell RNA seq analyses of T cells isolated from five human hepatocellular carcinoma patients had been previously described (Zheng et al., 2017). This dataset was queried for genes of interest, and 2D and box plots were generated using Tamatoa. Specifically, expression of TIGIT, CD112R, CD226, and PD-1 on T cells from tumor tissues was queried.

CD112R Binding Assay and FACS Staining

To evaluate binding of anti-CD112R tool antibodies (PL-52576, PL-52575, PL-52577) to human CD112R, CHO K1 cells transfected to express CD112R were incubated with anti-CD112R antibody, CD ligand Fc (Sino biological), or isotype control for 1 hour at 4 C, and the bound antibody was detected with APC conjugated anti-human IgG secondary antibody (R&D systems) or PE conjugated anti-mouse IgG secondary antibody (Jackson Immunoresearch).

To characterize the expression of CD112R, PD-1, and TIGIT expression by flow cytometry, previously activated T cells or dissociated tumor cells were blocked with Fc blocking reagent (10 min at room temperature) and incubated with fluorochrome conjugated antibodies for 45 mins at 4 C. For CD112R detection, a secondary PE-conjugated anti human IgG (Jackson Immunoresearch) was added as a second step. In some cases, cells were fixed using IC fixation buffer (ebioscience). Data were acquired using BD Symphony flow cytometer and analyzed using FlowJo software.

Primary Human T Cell Activation and Expansion

Pan T cells and memory CD8 T cells were purified from previously frozen PBMCs (Cepheus Bioscience) using magnetic bead based human Pan T cell (miltenyi Biotec) and memory CD8 T cell isolation kits (STEMCELL technologies) using manufacturers recommended protocol. Pan T cells were cultured with human anti-$CD^3$/anti-CD28 dynabeads (Life technologies) at 1:1 ratio in the presence of 50 IU/ml recombinant human IL2 (R&D systems) for 3 days and then, after removal activation beads, were rested for 3 days without supplemental IL2. Memory CD8 T cells were cultured with human anti-$CD^3$/anti-CD28 dynabeads (Life technologies) at 1:1 ratio in presence of 50 IU/ml recombinant human IL2 (R&D systems) for 7 days, IL2 was replenished every 2-3 days, and then, after removal of activation beads, were rested for 2 days in presence of 50 IU/ml recombinant IL2. For expanding $CMVpp65_{(495-503)}$ reactive CD8+ T cells, PBMC from HLA-A2+, $CMVpp65_{(495-503)}$ reactive CD8+ donors were cultured with $CMVpp65_{(495-503)}$ (Anaspec) peptide-pulsed monocyte derived dendritic cells, generated using monocyte derived dendritic cell differentiation kit (R&D systems), in the presence of 50 IU/ml recombinant IL2 (R&D Systems), 10 ng/ml recombinant IL7 (R&D System), 1000 IU/ml recombinant IL4 (R&D systems) for 14 days in a Grex-10 flask (Wilson wolf manufacturing). Media used for culturing and expanding T cells is RPMI complete media (RPMI 1640 supplemented with Glutamax (GIBCO)+10% FBS (GIBCO)+Pen/strep+NEAA+Sodium Pyruvate+β-ME+HEPES (GIBCO)).

Generation of Engineered CHO Cells

CHO K1 cell line expressing anti CD3 scfv was (obtained from internal Amgen sources) used for transfection to induce CD112 and CD155 expression. CHO cell line expressing 'low' anti-CD3 scfv was transfected with pcDNA3.1_human CD112 var delta zeo vector (obtained from internal Amgen source) using Lipofectamine 2000 transfection kit (Invitrogen) using manufacturer's recommended protocol. After transfection, CHO cells expressing CD112 were sorted as single cell clones and allowed to outgrow in selection media (Ham's F12 media containing (GIBCO) 1× glutamax (GIBCO), 10% heat inactivated FBS (GIBCO), 200 ug/ml hygromycin, and 100 ug/ml zeocin and (Thermo Fischer)). To generate CHO cells expressing both CD112, CD155, and anti-CD3scfv, previously generated CHO cell line expressing anti-CD3scfv, and CD112, was transfected with pcDNA3.2_human CD155 var 1_puro vector (obtained from internal Amgen source) using Lipofectamine 2000 (Invitrogen). After transfection, CHO cells expressing CD112, anti-CD3scfv, and CD155 were sorted into single cell clones and allowed to expand in selection media (Ham's F12 media containing (GIBCO) 1× glutamax (GIBCO), 10% heat inactivated FBS (GIBCO), 200 ug/ml hygromycin, 15 ug/ml puromycin, and 100 ug/ml zeocin and (Thermo Fischer)). To generate CHO K1 cell line expressing human CD112R, CHO K1 cells were transfected with vector pMSCV_FLAG_human CD112R (N81D)(41-326)_IRES_EGFP, using Lipofectamine 2000 kit (Invitrogen) using manufacturer recommended protocol.

In Vitro Primary Cell Assays

To interrogate effect of blocking CD112R-CD112 and CD226-CD112 interaction on T cell function, CHO cells, either transfected to express CD112 or with an empty vector along with aCD3scfv, were co-cultured with previously expanded Pan T cells and soluble anti-CD28 (Biolegend) in the presence of anti-CD112R antibody or isotype control, with or without anti-CD226 (Abcam). Cell culture supernatant was harvested after 24 hours and evaluated for IL2 using standard ELISA kit (R&D Systems) as a readout for T cell function. To evaluate the effect of co-blocking TIGIT and CD112R on CD8 T cell function, CHO cells expressing CD112 and CD155 were co-cultured with previously expanded memory CD8 T cells and soluble anti-CD28 (Biolegend) in the presence of the blocking antibodies and supernatant was harvested after 24 hours and analyzed using MSD human IFNγ V-plex detection kit.

For antigen-specific CTL assay, SKMEL30 cells were pretreated with 100 ng/ml recombinant IFNγ for 24 hours, pulsed with 1 ug/ml $CMVpp65_{(495-503)}$ peptide and co-cultured with previously expanded $CMVpp65_{(495-503)}$ reactive CD8+ T cells for 72 hours in the presence of single, double, or triple combinations of anti-TIGIT, anti-CD112R, and anti-PD-1 antibodies in a 1:1:1 ratio in RPMI complete media (RPMI 1640 supplemented with Glutamax (GIBCO), 10% FBS (GIBCO), Pen/strep, NEAA, Sodium Pyruvate, β-ME and HEPES (GIBCO)). Cell culture supernatant was harvested after 72 hours and was evaluated for IFNγ using CBA cytokine detection kit (BD bioscience) as readout of CD8 T cell activation.

Dissociated Human Tumor Cell Analysis

Tumor tissues from tumor resection surgery were provided by CPMC (California Pacific Medical Center) and through MT group (Van Nuys, CA) with patient consent. The tissues were processed by first cutting into small pieces, followed by enzymatic digestion and mechanical dissociation with GentleMacs in digestion buffer (DMEM/F12 supplemented with 10% FBS, Penn/strep, L-Glutamine, HEPES, 1.5 mg/ml collagenase type II, 10 ug/ml hyaluronidase type iv, 10 uM Y-27632 and DNase I) at 37C. After digestion, cell suspension was filtered through 70 um mesh filter, treated with RBC lysis buffer and resuspended in culture media.

TIL stimulation assay was performed by culturing 250,000 dissociated tumor cells per well in a 96-well plate, in the presence of combinations of anti-CD112R, TIGIT, PD-1, and/or isotype control antibodies, each at 10 ug/ml for 30 ug/ml total antibodies per sample in RPMI complete media at 37° C. Supernatant was harvested on day 3 and day 6 and analyzed for IFNγ by MSD.

Example 11

This example demonstrates formulations comprising CD112R mAbs and TIGIT mAbs.

Formulations comprising anti-TIGIT mAbs, anti-CD112R mAbs, or both (140 mg/mL total antibody concentration) were prepared and characterized for viscosity and stability. The anti-TIGIT mAbs used in these studies included 43B7 and 66H9, and the anti-CD112R mAbs used were 1E1, 29E10 and 24F1. The results are shown in Table 21.

TABLE 21

| Formulation No. | TIGIT mAb | CD112R mAb | Viscosity (cP) |
|---|---|---|---|
| 1 | — | 1E1 | 11.0 |
| 2 | — | 29E10 | 25.2 |
| 3 | — | 24F1 | 10.3 |
| 4 | 43B7 | — | 7.5 |
| 5 | 66H9 | — | 9.9 |
| 6 | 66H9 | 1E1 | 10.4 |
| 7 | 66H9 | 29E10 | 13.7 |
| 8 | 66H9 | 24F1 | 10.2 |
| 9 | 43B7 | 1E1 | 9.3 |
| 10 | 43B7 | 29E10 | 12.4 |
| 11 | 43B7 | 24F1 | 8.9 |

Co-formulations comprising 1:1 mixtures of an anti-TIGIT mAb and an anti-CD112R mAb are formulated at about 70 mg/mL of each type of mAb. Single mAb formulations comprised either of anti-TIGIT mAb or anti-CD112R mAb were prepared at a 140 mg/mL concentration.

As shown in Table 21, formulations comprising both anti-TIGIT mAbs, anti-CD112R mAbs demonstrated acceptable viscosities of less than 15 cP. While formulations comprising either 24F1 or 1E1 demonstrated about the same viscosities (~9.0 to ~11.0), formulations comprising anti-CD112R mAb 29E10 exhibited higher viscosities, The formulations were analyzed by size exclusion chromatography (SEC) for high molecular weight (HMW) species formation after two weeks of storage at 40° C. (2 wk40 C), compared to initial HMW species formation ($T_0$, no storage time). The results are shown in Table 22.

TABLE 22

| | % Main Peak | | % HMW species | | Δ % |
|---|---|---|---|---|---|
| Formulation No. | $T_0$ | 2 wk 40 C. | $T_0$ | 2 wk 40 C. | HMW |
| 9 | 98.2 | 96.2 | 1.0 | 1.9 | 0.9 |
| 11 | 97.9 | 95.6 | 1.3 | 2.5 | 1.2 |
| 10 | 98.3 | 96.2 | 1.0 | 2.0 | 1.1 |
| 6 | 97.7 | 95.9 | 1.3 | 2.7 | 1.4 |
| 8 | 97.6 | 95.2 | 1.6 | 3.5 | 1.9 |
| 7 | 97.7 | 95.5 | 1.4 | 3.0 | 1.6 |

As shown in Table 22, all formulations demonstrated less than 2% change in HMW species formation after 2 weeks of accelerated storage (40° C.). The change in % HMW species was the least for the formulation comprising 1E1 and 43B7, though the change in % HMW species also was less than 1.5% for most other formulations.

These data support that formulations comprising both anti-TIGIT mAbs, anti-CD112R mAbs are stable and exhibit an acceptable viscosity even at higher concentrations (e.g., greater than 100 μg/mL).

Example 12

This example demonstrates the in vitro activity of formulations comprising anti-CD112R mAbs and anti-TIGIT mAbs.

The in vitro activity of formulations comprising anti-CD112R mAb (24F1) and anti-TIGIT mAb (43B7.002.015) at varying ratios (9:1, 3:1, 1:1, 1:3, and 1:9 TIGIT mAb:CD112R mAb) with a fixed amount of PD-1 mAb was assessed in vitro by measuring the amount of IFN-γ produced by cytotoxic T lymphocytes upon stimulation with the formulation. The assay was performed at two different total mAb concentrations: 1.5 nM (which simulates a setting where target coverage has not reached saturation) and 30 nM (which simulates saturation). The anti-PD-1 mAb concentration was fixed at 0.5 nM (for the formulations comprising 1.5 nM total mAb concentration) and 10 nM (for the formulations comprising 30 nM total mAb concentration). Table 23 summarizes the amounts of each antibody in the formulations.

TABLE 23

| Total Ab concentration (nM) | TIGIT mAb (nM) | CD112R mAb (nM) | Anti-PD-1 (nM) | TIGIT mAb:CD112R mAb Ratio | Bar # |
|---|---|---|---|---|---|
| 1.5 | 0.9 | 0.1 | 0.5 | 9:1 | 1 |
| 1.5 | 0.75 | 0.25 | 0.5 | 3:1 | 2 |
| 1.5 | 0.5 | 0.5 | 0.5 | 1:1 | 3 |
| 1.5 | 0.25 | 0.75 | 0.5 | 1:3 | 4 |
| 1.5 | 0.1 | 0.9 | 0.5 | 1:9 | 5 |
| 1.5 | 0.5 | 0.5 | 0 | na | 6 |
| 1.5 | 0.9 | 0 | 0.5 | na | 7 |
| 1.5 | 0 | 0.9 | 0.5 | na | 8 |
| 1.5 | 0.9 | 0 | 0 | na | 9 |
| 1.5 | 0 | 0.9 | 0 | na | 10 |
| 1.5 | 0 | 0 | 10 | na | 11 |
| 1.5 | 0 | 0 | 0 | na | 12 |
| 30 | 18 | 2 | 10 | 9:1 | 13 |
| 30 | 15 | 5 | 10 | 3:1 | 14 |
| 30 | 10 | 10 | 10 | 1:1 | 15 |
| 30 | 5 | 15 | 10 | 1:3 | 16 |
| 30 | 2 | 18 | 10 | 1:9 | 17 |
| 30 | 10 | 10 | 0 | na | 18 |
| 30 | 18 | 0 | 10 | na | 19 |
| 30 | 0 | 18 | 10 | na | 20 |
| 30 | 18 | 0 | 0 | na | 21 |
| 30 | 0 | 18 | 0 | na | 22 |
| 30 | 0 | 0 | 10 | na | 23 |
| 30 | 0 | 0 | 0 | na | 24 |

As shown in FIG. 19A, all formulations comprising TIGIT mAb and CD112R mAb at the total Ab amount of 1.5 nM (Bars 1-6) performed better than those formulations lacking both TIGIT mAb and CD112R mAb (Bars 7-12). Of the formulations comprising TIGIT mAb and CD112R mAb at the total Ab amount of 1.5 nM (Bars 1-6), the co-formulation having a 1:1 TIGIT mAb:CD112RmAb ratio performed the best as the highest amount of IFN gamma was produced. At the higher total Ab concentration, the responses were essentially the same (FIG. 19B), suggesting that the magnitude of response was driven by total target coverage rather than the ratio of the two mAbs.

Example 13

This example demonstrates the expression of CD112R and TIGIT on human TIL and circulating lymphocytes.

The success of the co-formulation comprising TIGIT mAb and CD112R mAb at a 1:1 ratio may be influenced by the expression of these targets (CD112R and TIGIT) on the targeted cells. Thus, the expression of CD112R and TIGIT was evaluated by flow cytometry on TILs, ex vivo primary human tumor tissues and matching blood samples. It was hypothesized that if the targets were expressed to largely different degrees, then the use of a ratio other than 1:1 may be warranted. The results are shown in FIGS. 20A-20C. As shown in FIG. 20A, CD8+ T cells trended toward higher expression levels of TIGIT than CD112R, whereas NK cells trended toward increased CD112R expression in tumor tissues. Furthermore, peripheral CD8+ T and NK cells expressed more comparable levels of CD112R and TIGIT compared to TILs (FIG. 20B). Tumor cells expressed varying levels of the ligands CD155 and CD112 (FIG. 20C). At least some of the CD112R and TIGIT mAbs of the present disclosure exhibit similar range of affinities to their respective targets and nearly identical pharmacokinetic profiles. Because CD112R and TIGIT expression is variable from donor to donor in tumor versus blood, as is that of the ligands, target saturation via dosing with mAb combinations at 1:1 ratio is reasonable and an elegant approach to cover targets that ultimately converge on the same downstream pathway.

Example 14

This example demonstrates the in vivo pharmacokinetics (PK) of CD112R mAb and TIGIT mAb in non-human primates (NHP).

An exploratory toxicology study was performed to evaluate the toxicity and PK characteristics of a formulation comprising anti-CD112R mAb (24F1), anti-TIGIT mAb (43B7.002.015), or both antibodies. Via slow intravenous (IV) bolus injection, groups of male cynomolgus monkeys (3 animals per group) were dosed as follows: Group 1 received sequential administration of 0.5 mg/kg anti-CD112R mAb and 0.5 mg/kg anti-TIGIT mAb. Group 2 received 5 mg/kg anti-TIGIT mAb, while Group 3 received 5 mg/kg anti-CD112R mAb. Mean concentration-time profiles are provided in FIG. 21. As shown in this figure, after a single IV administration, exposure increased approximately dose proportionally between 0.5 and 5 mg/kg for TIGIT mAb and slightly higher than dose proportionally for CD112R mAb at the same dose levels. Mean peak concentrations and areas under the concentration-time curve were similar CD112R mAb and TIGIT mAb at both dose levels, suggesting PK profiles are suitable for coformulation at a 1:1 ratio.

Example 15

This example demonstrates the CD112R mAb+TIGIT mAb activity in primary human Natural Killer (NK) cells.

Since CD112R and TIGIT also regulate NK cell activity (Li et al, 2020; and Stanietsky et al, 2013), the activities of anti-CD112R mAb (24F1) and anti-TIGIT mAb (43B7.002.015), and co-formulations comprising a 1:1 ratio of the anti-CD112R mAb (24F1) and anti-TIGIT mAb (43B7.002.015), were evaluated in an NK cell activation assay. For this assay, primary NK cells were purified from blood from healthy donors, and then co-cultured with tumor cells. NK cell response as represented by IFNγ production and tumor cell killing was measured. The purified NK cells expressed high levels of CD226, TIGIT, and CD112R but very low levels of PD-1 (FIG. 22A). The target tumor cells endogenously expressed the ligands CD112, CD155, and PD-L1 (FIG. 22B). As shown in FIGS. 22C-22D, each of the CD112R mAbs and TIGIT mAbs individually induced NK cell activation. The combination of the two Abs provided a further increase in tumor cell killing (FIG. 22C) and IFN production (FIG. 22D). A co-formulation comprising all three antibodies (CD112R mAbs, TIGIT mAbs, and PD-1 mAbs; 3×) did not further increase the tumor cell killing or IFN production, which result is consistent with the very low-level expression of PD-1 (FIG. 22A).

These data support the ability of formulations comprising both anti-TIGIT mAb and anti-CD112R mAb to induce NK cell activity.

Example 16

This example describes an ex vivo primary human tumor-infiltrating lymphocyte assay.

To simulate tumor-infiltrating T and NK cell responses to endogenous tumor cells more closely, an assay using dissociated ex vivo primary human tumor tissues was developed. A single-cell suspension from dissociated tumor tissue was cultured in the presence of anti-TIGIT mAb, anti-CD112R mAb, anti-PD-1 mAb, or combinations thereof without any exogenous antigens. The idea behind the assay was that the endogenous tumor cells supply tumor-derived antigens to T and/or NK cells. Out of 10 different samples representing 4 different solid tumor indications (pancreatic (PANC), colorectal (CRC), triple negative breast cancer (TNBC), and gastrointestinal (GIST) cancer), a response in 6 samples, as measured by IFNγ on day 3, was detected. In each of these cases, the combination including all three mAbs (anti-TIGIT mAb, anti-CD112R mAb, and anti-PD-1 mAb) generated the most robust response (FIG. 23), although the maximal fold-induction varied from sample to sample (data not shown).

Example 17

This example demonstrates the in vivo efficacy of formulations comprising combinations of anti-TIGIT mAbs, anti-CD112R mAbs and PD-1 mAbs in xenograft models.

The following materials and methods were used for this experiment.

Animals, Tissues and Materials

Approximately 60-100 mice (female) were used per study. Each weighed approximately 17-24 g at first measurement. The strains of mice used in the study included: Balb/c TIGIT×CD112R double KO, Balb/c CD112R-GFP KI, Balb/c TIGIT KO, Balb/c TIGIT×CD112R WT/WT; C57BL/6 TIGIT×CD112R double KO, C57BL/6 CD112R-GFP KI, C57BL/6 TIGIT KO, C57BL/6 TIGIT×CD112R WT/WT; NOD SCID IL2rg (NSG). Balb/c and C57BL/6 were sourced from Charles River Labs and the NSG mice were obtained from Jackson Labs. At the time of tumor implantation, the mice were 4 to 12 weeks old. Balb/c mice were CT26 (colon carcinoma) tumor-bearing, C57BL/6 were B16F10 (melanoma) tumor-bearing, and NSG mice were CMV-SKMEL30 (melanoma) tumor-bearing.

Test articles included a co-formulation comprising a 1:1 ratio of anti-TIGIT mAb (43B7.002.015) and anti-CD112R mAb (24F1), anti-muPD-1 Clone 29F.1A12, anti-human PD-1 and control articles included vehicle control (100% DPBS), mIgG1 N297G Isotype Control, hIgG1 Isotype Control.

Methods

CT26, B16F10 and CMV-SKMEL30 cells were obtained from the Cancer Pharmacology Cell Bank (Amgen, Thousand Oaks). CT26 cells were maintained at 37° C. in RPMI-1640 supplemented with 10% FBS, 1% NaPyr, 1% HEPES and 1% NEAA. B16F10 cells were maintained at 37° C. in DMEM supplemented with 10% FBS. CMV-SKMEL30 cells were maintained at 37° C. in RPMI-1640 supplemented with 10% FBS, 1% NaPyr, 1% NEAA, 1% GlutaMAX, 5 ug/mL Blasticidin and 1 ug/mL puromycin. Cells were determined to be free of contamination with mycoplasma as well as a panel of murine vial pathogens in addition to being authenticated. T225 tissue culture flasks of cells were harvested and viable cells were quantified by trypan blue exclusion on the Vi-Cell XR (Beckman Coulter, Brea, CA). Female mice were injected with $3 \times 10^5$ CT26 or B16F10 cells in 0.1 mL serum-free media, or $1 \times 10^6$ CMV-SKMEL30 cells in 0.1 mL 1:1 RPMI:Matrigel (BD Biosciences, Bedford, MA) subcutaneously in the right flank. In the CMV-SKMEL30 model, mice were also injected with $2.5 \times 10^6$ CMV-expanded CTLs intravenously. Animals were randomized into groups such that every group had similar average tumor volumes of approximately 100 mm$^3$.

In CT26 and B16F10 syngeneic models, animals were dosed with isotype control or anti-murine PD-1 antibody at 100 μg/mouse. In the CMV-SK-MEL xenograft model, animals were dosed with isotype control antibodies, the anti-TIGIT-mAb/anti-CD112R mAb co-formulation (at 200 μg/mouse) and/or anti-PD-1 antibodies (at 300 μg/mouse) intraperitoneally (IP) twice weekly (2QW). Animals were weighed, and tumor volumes were measured twice per week. Tumor measurements were calculated from the length, width and height of tumors measured with a PRO-MAX electronic digital caliper (Japan Micrometer Mfg. Co. LTD). The tumor volume was calculated as [L×W×H] and expressed in mm$^3$.

Statistical Analysis

Data are expressed as mean tumor volume ±standard error of the mean (SEM) for each group plotted as a function of time. Statistical analysis to evaluate effect of treatment on tumor size over time relative to Control was performed using Liner Mixed Effects model implemented within the custom application IVEA (v1.2.1.019). Fixed effects included group, time with group*time interaction terms. Covariance structure was induced due to subject random effect. Dunnett's correction was applied for multiplicity.

Expressed data was analyzed using t-test/ANOVA implemented in the custom application IVEA (v1.2.1.019). Ordinary t-test/ANOVA are used when homogeneity and normality assumptions hold with Welch's correction in case of lack of homogeneity. Nonparametric option is used in case of non-normality. ANOVA multiplicity Dunnett/Tukey or equivalent correction is applied to control for Type I error.

Percent tumor growth inhibition (TGI) was calculated as the difference between the mean change of tumor volume of a test group and control group, using the formula:

% TGI=100−[(Treated Final Volume−Treated Initial Volume)/(Control Final Volume−Control Initial Volume)]×100

Results

In this study, the in vivo effects of CD112R+TIGIT+PD-1 triple blockade was evaluated in multiple mouse models. In a first model, knockout mouse strains lacking CD112R or TIGIT, or both, and were generated, and the effects of target deficiency together with or without PD-1 blocking mAb in syngeneic tumor models were evaluated. In a second model, a xenograft model where immunodeficient NSG mice were implanted with human melanoma tumor cell line (SK-MEL30) that were engineered to express CMV antigen, along with CMV Ag-specific CD8 T cells was generated. After tumors were established, mice were dosed with human PD-1 mAb, CD112R and TIGIT mAb combination, or PD-1+TIGIT+CD112R mAb triple combination. Tumor growth was measured over the course of study, and the percent tumor growth inhibition (TGI) at study termination was calculated to compare the activity of PD-1 single blockade, TIGIT+CD112R combination (double knockout or combination mAb blockade), or TIGIT+CD112R+PD-1 triple combination (TIGIT+CD112R double KO or mAb combination, plus PD-1 mAb) against isotype control-treated group.

The results of the study shown as tumor volume plotted as a function of time (post tumor implantation) are provided in FIGS. 24A-24C. As shown in FIG. 24A, mice that were treated with anti-PD-1 antibody and with TIGIT and CD112R genes knocked out, thereby providing a triple blockade of all three targets, exhibited the highest extent of tumor growth inhibition (TGI). Blockade of TIGIT (via gene KO) and blockade of PD-1 through antibody treatment provided a 60% TGI. Similar results were seen in TIGIT/CD112R double knock-out B16F10 mice treated with anti-PD-1 antibody. Triple blockade led to the greatest amount of TGI. As shown in FIG. 24C, triple blockade with anti-TIGIT mAb/antiCD112R mAb combination formulation plus anti-PD-1 mAb (purple) led to the largest decrease in tumor volume relative to tumor volume of isotype control treated mice (black). These results support that CD112R+TIGIT+PD-1 triple blockade inhibits tumor growth better than double combination or single blockade. The data of FIGS. 24A-24C support that triple blockade led to the most robust inhibition of tumor growth compared to groups treated with PD-1 mAb alone, or the TIGIT+CD112R combination. These results support that TIGIT+CD112R+PD-1 triple blockade is efficacious in inhibiting tumor growth in vivo.

These data support the treatment of tumors, as represented by in vivo tumor growth inhibition, with blockade of TIGIT, CD112R and PD-1.

Example 18

This example demonstrates the stability of anti-TIGIT mAb/anti-CD112R mAb formulations.

Anti-CD112R mAb (24F1) was formulated with or without anti-TIGIT mAb (either 43B7.002.015 (TIGIT-10) or 66H9.009 (TIGIT-12)) in 9% (w/v) sucrose and 10 mM acetate. Each formulation further comprised a final concentration of 0.01% (w/v) polysorbate 80 (PS80). The total antibody concentration of each formulation was 140 mg/mL. Formulations comprising both anti-CD112R mAb and an anti-TIGIT mAb comprised ~70 mg/mL each at a 1:1 ratio. The formulations were then stored at −30° C., 4° C., 25° C., or 40° C. for up to 4 weeks. Samples of each formulation were then analyzed by size exclusion-ultra high performance liquid chromatography (SE-UHPLC) and reduced capillary electrophoresis-sodium dodecyl sulfate (rCE-SDS) to evaluate the stability of each formulation. Stability was determined by calculating the percentage of each separated component as compared to the total integrated area. The viscosity of each formulation (at 1000 s-1 shear at 25° C.) was additionally evaluated using a cone and plate rheometer.

The SE-UHPLC results are provided in FIGS. 25A-25H and Tables 24-27. Tables 24-27 provide the % HMW species and % antibody main peak upon storage at −30° C., 4° C., 25° C., and 40° C., respectively, and the data are shown in FIGS. 25A-D (% HMW upon storage at −30° C., 4° C., 25° C., and 40° C., respectively) and FIGS. 25E-25H (% main peak upon storage at −30° C., 4° C., 25° C., and 40° C., respectively). As shown in these figures and tables, less than 2% HMW species formed and greater than 96.5% main peak was maintained, even after being stored at 40° C. for up to 4 weeks, suggesting the high stability of the antibody formulations.

TABLE 24

Storage Temperature = −30° C.

| | % HMW | | | | % Main Peak | | | |
|---|---|---|---|---|---|---|---|---|
| Ab Formulation | T = 0 | T = 1 wk | T = 2 wk | T = 4 wk | T = 0 | T = 1 wk | T = 2 wk | T = 4 wk |
| CD112R | 0.180 | | | 0.186 | 99.4 | | | 99.8 |
| TIGIT-10 | 0.180 | | | 0.187 | 99.8 | | | 99.8 |
| TIGIT-12 | 0.394 | | | 0.403 | 99.6 | | | 99.6 |
| CD112R + TIGIT-10 | 0.250 | | | 0.233 | 99.8 | | | 99.8 |
| CD112R + TIGIT-12 | 0.360 | | | 0.357 | 99.6 | | | 99.6 |

TABLE 25

Storage Temperature = 4° C.

| | % HMW | | | | % Main Peak | | | |
|---|---|---|---|---|---|---|---|---|
| AB Formulation | T = 0 | T = 1 wk | T = 2 wk | T = 4 wk | T = 0 | T = 1 wk | T = 2 wk | T = 4 wk |
| CD112R | 0.180 | 0.174 | | 0.168 | 99.4 | 99.4 | | 99.8 |
| TIGIT-10 | 0.180 | 0.164 | | 0.154 | 99.8 | 99.8 | | 99.8 |
| TIGIT-12 | 0.394 | 0.390 | | 0.382 | 99.6 | 99.6 | | 99.6 |
| CD112R + TIGIT-10 | 0.250 | 0.256 | | 0.262 | 99.8 | 99.7 | | 99.7 |
| CD112R + TIGIT-12 | 0.360 | 0.368 | | 0.377 | 99.6 | 99.6 | | 99.6 |

TABLE 26

Storage Temperature = 25° C.

| | % HMW | | | | % Main Peak | | | |
|---|---|---|---|---|---|---|---|---|
| Ab Formulation | T = 0 | T = 1 wk | T = 2 wk | T = 4 wk | T = 0 | T = 1 wk | T = 2 wk | T = 4 wk |
| CD112R | 0.180 | 0.171 | 0.180 | 0.198 | 99.4 | 99.3 | 99.3 | 99.1 |
| TIGIT-10 | 0.180 | 0.151 | 0.158 | 0.175 | 99.8 | 99.4 | 99.4 | 99.3 |
| TIGIT-12 | 0.394 | 0.388 | 0.434 | 0.467 | 99.6 | 99.6 | 98.4 | 98.2 |
| CD112R + TIGIT-10 | 0.250 | 0.298 | 0.326 | 0.381 | 99.8 | 99.7 | 99.2 | 99.0 |
| CD112R + TIGIT-12 | 0.360 | 0.431 | 0.477 | 0.587 | 99.6 | 99.6 | 98.8 | 98.6 |

TABLE 27

Storage Temperature = 40° C.

| | % HMW | | | | % Main Peak | | | |
|---|---|---|---|---|---|---|---|---|
| Ab Formulation | T = 0 | T = 1 wk | T = 2 wk | T = 4 wk | T = 0 | T = 1 wk | T = 2 wk | T = 4 wk |
| CD112R | 0.180 | 0.239 | 0.299 | 0.464 | 99.4 | 98.9 | 98.4 | 97.5 |
| TIGIT-10 | 0.180 | 0.189 | 0.239 | 0.332 | 99.8 | 99.1 | 98.6 | 97.8 |
| TIGIT-12 | 0.394 | 0.577 | 0.731 | 1.001 | 99.6 | 98.0 | 97.6 | 96.7 |
| CD112R + TIGIT-10 | 0.250 | 0.485 | 0.651 | 1.023 | 99.8 | 98.8 | 99.2 | 97.0 |
| CD112R + TIGIT-12 | 0.360 | 0.782 | 1.093 | 1.646 | 99.6 | 98.4 | 97.7 | 96.7 |

The results of the rCE-SDS assay are provided in Table 28 of FIG. 26. In this assay, the protein species are bound to SDS, an anionic detergent, and electokinetically injected into a bare fused silica capillary filled with SDS gel buffer. An electric voltage is applied across the capillary, under which the SDS coated proteins are separated by their difference in migration in a hydrophilic polymer-based solution. Proteins are detected by a photodiode array (PDA) detector as they pass through a UV detection window. Stability is evaluated by determining the percent corrected peak area of reach component. The rCE-SDS method separates the heavy chain (HC), light chain (LC), non-glycosylated HC (NGHC), and other minor peak species and groups under reducing conditions. As shown in Table 24, all formulations were relatively stable, forming about 4% LMW+ HMW peaks after storage −30° C., 4° C., 25° C., or 40° C. for up to 4 weeks. The formulations comprising TIGIT-12 mAb, however, associated with higher % ages. Without being bound to theory, the higher % is caused by increased clipping of this antibody.

The results of the viscosity assay are shown in FIG. 27 and Table 29. As shown in this figure and table, in general, the viscosity of the formulation increased as the total antibody concentration increased. However, all formulations tested demonstrated a viscosity of less than 15 cP and thus were considered acceptable.

TABLE 29

| Ab Formulation | Total Ab Concentration (mg/mL) | Avg Viscosity (cP) | Std Dev |
|---|---|---|---|
| CD112R | 140 | 11.08 | 0.307 |
| TIGIT-10 | 140 | 5.98 | 0.064 |
| TIGIT-12 | 140 | 7.35 | 0.044 |
| CD112R | 70 | 2.88 | 0.377 |
| TIGIT-10 | 70 | 2.30 | 0.041 |
| TIGIT-12 | 70 | 2.37 | 0.043 |
| 1:1 Coformulation CD112R + TIGIT-10 | 140 | 8.34 | 0.922 |
| 1:1 Coformulation CD112R + TIGIT-12 | 140 | 8.22 | 0.312 |

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and similar referents in the context of describing the disclosure (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted.

Recitation of ranges of values herein are merely intended to serve as a shorthand method of referring individually to each separate value falling within the range and each endpoint, unless otherwise indicated herein, and each separate value and endpoint is incorporated into the specification as if it were individually recited herein.

All methods described herein can be performed in any suitable order unless otherwise indicated herein or otherwise clearly contradicted by context. The use of any and all examples, or exemplary language (e.g., "such as") provided herein, is intended merely to better illuminate the disclosure and does not pose a limitation on the scope of the disclosure unless otherwise claimed. No language in the specification should be construed as indicating any non-claimed element as essential to the practice of the disclosure.

Preferred embodiments of this disclosure are described herein, including the best mode known to the inventors for carrying out the disclosure. Variations of those preferred embodiments may become apparent to those of ordinary skill in the art upon reading the foregoing description. The inventors expect skilled artisans to employ such variations as appropriate, and the inventors intend for the disclosure to be practiced otherwise than as specifically described herein. Accordingly, this disclosure includes all modifications and equivalents of the subject matter recited in the claims appended hereto as permitted by applicable law. Moreover, any combination of the above-described elements in all possible variations thereof is encompassed by the disclosure unless otherwise indicated herein or otherwise clearly contradicted by context.

SEQUENCE LISTING (2094 sequences)

SEQ ID NO: 1 - protein, 244 aa, Artificial Sequence
  Synthetic
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 2 - DNA, 2926 bp, Artificial Sequence
  Synthetic
acatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaaccgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaagacttagactggggttgacaattgttttagcaacaagacaattcaactatttctcctaggatttttattattattattttttcacttttctaccaaatgggttacataggaagaatgaactgaaatctgtccagagctccaagtcctttggaagaaagattagatgaacgtaaaaatgttgttgtttgctgtggcagtttacagcatttttcttgcaaaattagtgcaaatctgttggaaatagaacacaattcacaaattggaagtgaactaaaatgtaatgacgaaaagggagtagtgttttgatttggaggaggtgtatattcggcagaggttggactgagagttgggtgttatttaacataattatggtaattgggaaacatttataaacactattgggatggtgataaaatacaaaagggcctatagatgttagaaatgggtcaggttactgaaatgggattcaatttgaaaaaaatttttttaaatagaactcactgaactagattctcctctgagaaccagagaagaccatttcatagttggattcctggagacatgcgctatccaccacgtagccactttccacatgtggccatcaaccacttaagatggggttagtttaaatcaagatgtgctgttataattggtataagcataaaatcacactagattctggagatttaatatgaataataagaatactatttcagtagttttggtatattgtgtgtcaaaaatgataatattttggatgtattgggtgaaataaaatattaacatta

SEQ ID NO: 3 - protein, 326 aa, Artificial Sequence
  Synthetic
MRTEAQVPALQPPEPGLEGAMGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHRPAPRLQPSRTSPQAPRARAWAPSQASQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

SEQ ID NO: 4 - DNA, 1587 bp, Artificial Sequence
  Synthetic
gggcagaggactgctgtttgctgacacaatcttggtgcgttggaagtgaaagggaagaggcactggtggctgtgctttgggcccgagcagccagaagccagttgccatcacctatgacgaggagacagcgcctggggcagagcccagtatggggcctagccagggctgggttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacctggactggagggggccatggggcaccggaccctggtcctgccctgggtgctgctgaccttgtgtgtcactgcggggaccccggaggtgtgggttcaagttcggatggaggccaccgagctctcgtccttcaccatccgttgtgggttcctggggtctggctccatctccctggtgactgtgagctgggggggccccaacggtgctggggggaccacgctggctgtgttgcacccagaacgtggcatccggcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgccccgccgactcctgcccccattctgcgggcagacctggccgggatcttgggggtctcaggagtcctcctctttggctgtgtctacctccttcatctgctgcgccgacataagcaccgccctgcccctaggctccagccgtcccgcaccagcccccaggcaccgagagcacgagcatgggcaccaagccaggcctcccaggctgctcttcacgtcccttatgccactatcaacaccagctgccgcccagctactttggacacagctcacccccatggggggccgtcctggtgggcgtcactccccacccacgctgcacaccggccccagggccctgccgcctgggcctccacacccatccctgcacgtggcagctttgtctctgttgagaatggactctacgctcaggcaggggagaggcctcctcacactggtcccggcctcactcttttccctgaccctcgggggcccagggccatggaaggacccttaggagttcgatgagagagaccatgaggccactgggctttccccctcccaggcctcctgggtgtcacccccttactttaattcttgggcctccaataagtgtcccataggtgtctggccaggcccacctgctgcggatgtggtctctgtgtgtgcgtgtgtgggcacaggtgtgagtgtgtgagtgacagttaccccatttcagtcatttcctgctgcaactaagtcagcaacacagtttctctgatgtcgaaaaaaaaaaaaaaaaaa

SEQ ID NO: 5 - protein, 288 aa, Artificial Sequence
  Synthetic
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 6 - DNA, 2097 bp, Artificial Sequence
  Synthetic
gctcacctccgcctgagcagtggagaaggcggcactctggtggggctgctccaggcatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaa

SEQ ID NO: 7 - protein, 372 aa, Artificial Sequence
  Synthetic
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGTEHASASANGHVSYSAVSRENSSSQDPQTEGTR

SEQ ID NO: 8 - protein, 538 aa, Artificial Sequence
  Synthetic
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 9 - protein, 448 aa, Artificial Sequence
  Synthetic Polypeptide
QVQLVQSGAEVKKPGASVKVSCQASGYTFTDYYIYWVRQAPGQGLEWMGWINPNSGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10 - protein, 214 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQLNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11 - protein, 118 aa, Artificial Sequence
  Synthetic Polypeptide
QVQLVQSGAEVKKPGASVKVSCQASGYTFTDYYIYWVRQAPGQGLEWMGWINPNSGGTNYAQKFQGRVTMTRDTSISTAYIELSRLRSDDTAVYYCAREDNFNGMDVWGQGTTVTVSS

SEQ ID NO: 12 - protein, 108 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQLNSYPLTFGGGTKVEIKR

SEQ ID NO: 13 - protein, 5 aa, Artificial Sequence
  Synthetic Polypeptide
DYYIY

SEQ ID NO: 14 - protein, 18 aa, Artificial Sequence
  Synthetic Polypeptide
GWINPNSGGTNYAQKFQG

SEQ ID NO: 15 - protein, 9 aa, Artificial Sequence
  Synthetic Polypeptide
EDNFNGMDV

SEQ ID NO: 16 - protein, 11 aa, Artificial Sequence
  Synthetic Polypeptide
RASQGIRNDLG

SEQ ID NO: 17 - protein, 7 aa, Artificial Sequence
  Synthetic Polypeptide
AASSLQS

SEQ ID NO: 18 - protein, 9 aa, Artificial Sequence
  Synthetic Polypeptide
LQLNSYPLT

SEQ ID NO: 19 - protein, 448 aa, Artificial Sequence
  Synthetic Polypeptide
QVQLVQSGAEVKKPGASVKVSCKASGYTFTDYYIYWVRQAPGQGLEWMGWINPNAGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - protein, 214 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21 - protein, 118 aa, Artificial Sequence
  Synthetic Polypeptide
QVQLVQSGAEVKKPGASVKVSCKASGYTFTDYYIYWVRQAPGQGLEWMGWINPNAGGTNYAQKFQGRVTMTRDTSISTAYIELSRLRSDDTAVYYCAREDNFNGMDVWGQGTTVTVSS

SEQ ID NO: 22 - protein, 108 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQLNAYPLTFGGGTKVEIKR

SEQ ID NO: 23 - protein, 5 aa, Artificial Sequence
  Synthetic Polypeptide
DYYIY

SEQ ID NO: 24 - protein, 17 aa, Artificial Sequence
  Synthetic Polypeptide
WINPNAGGTNYAQKFQG

SEQ ID NO: 25 - protein, 9 aa, Artificial Sequence
  Synthetic Polypeptide
EDNFNGMDV

SEQ ID NO: 26 - protein, 11 aa, Artificial Sequence
  Synthetic Polypeptide
RASQGIRNDLG

SEQ ID NO: 27 - protein, 7 aa, Artificial Sequence
  Synthetic Polypeptide
AASSLQS

SEQ ID NO: 28 - protein, 9 aa, Artificial Sequence
  Synthetic Polypeptide
LQLNAYPLT

SEQ ID NO: 29 - protein, 448 aa, Artificial Sequence
  Synthetic Polypeptide
EVQLVESGGGLVQPGGSLRLSCAASGFTFSRDDMHWVRQATGKGLEWVAGIDNAGDTYYPGSVKGRFTISRENAKNSLYLQMNSLRAGDTAIYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 214 aa, Artificial Sequence
  Synthetic Polypeptide
DIQMTQSPSSLSASVGDRVTITCRASQGIRNDLGWYQQKPGKAPKRLIYSASSLQSGVSSRFSGSGSGTEFTLTISSLQPEDFATYYCLQSNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 31 - protein, 118 aa, Artificial Sequence
  Synthetic Polypeptide
EVQLVESGGGLVQPGGSLRLSCAASGFTFSRDDMHWVRQATGKGLEWVAGIDNAGDTYYPGSVKGRFTISRENAKNSLYLQMNSLRAGDTAIYYCAREGQWPYGMDVWGQGTTVTVSS

SEQ ID NO: 32 - protein, 108 aa, Artificial Sequence
  Synthetic Polypeptide
DIQMTQSPSSLSASVGDRVTITCRASQGIRNDLGWYQQKPGKAPKRLIYSASSLQSGVSSRFSGSGSGTEFTLTISSLQPEDFATYYCLQSNSYPLTFGGGTKVEIKR

SEQ ID NO: 33 - protein, 5 aa, Artificial Sequence
  Synthetic Polypeptide
RDDMH

SEQ ID NO: 34 - protein, 16 aa, Artificial Sequence
  Synthetic Polypeptide
GIDNAGDTYYPGSVKG

SEQ ID NO: 35 - protein, 10 aa, Artificial Sequence
  Synthetic Polypeptide
EGQWPYGMDV

SEQ ID NO: 36 - protein, 11 aa, Artificial Sequence
  Synthetic Polypeptide
RASQGIRNDLG

SEQ ID NO: 37 - protein, 7 aa, Artificial Sequence
  Synthetic Polypeptide
SASSLQS

SEQ ID NO: 38 - protein, 9 aa, Artificial Sequence
  Synthetic Polypeptide
LQSNSYPLT

SEQ ID NO: 39 - protein, 447 aa, Artificial Sequence
  Synthetic Polypeptide
EVQLVESGGGLVQPGGSLRLSCAASGFTFRNYDMHWVRQVPGKGLEWVSDIGNSGETYYLGSVKGRFTISRENAKNSLYLQMNSLRAGDTAVYYCVREEFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - protein, 214 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41 - protein, 117 aa, Artificial Sequence
  Synthetic Polypeptide
EVQLVESGGGLVQPGGSLRLSCAASGFTFRNYDMHWVRQVPGKGLEWVSDIGNSGETYYLGSVKGRFTISRENAKNSLYLQMNSLRAGDTAVYYCVREEFGYGMDVWGQGTTVTVSS

SEQ ID NO: 42 - protein, 108 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKR

SEQ ID NO: 43 - protein, 5 aa, Artificial Sequence
  Synthetic Polypeptide
NYDMH

SEQ ID NO: 44 - protein, 16 aa, Artificial Sequence
  Synthetic Polypeptide
DIGNSGETYYLGSVKG

SEQ ID NO: 45 - protein, 9 aa, Artificial Sequence
  Synthetic Polypeptide
EEFGYGMDV

SEQ ID NO: 46 - protein, 11 aa, Artificial Sequence
  Synthetic Polypeptide
RASQGIRNDLG

SEQ ID NO: 47 - protein, 7 aa, Artificial Sequence
  Synthetic Polypeptide
AASSLQS

SEQ ID NO: 48 - protein, 9 aa, Artificial Sequence
  Synthetic Polypeptide
LQHNSYPLT

SEQ ID NO: 49 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAIYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 214 aa, Artificial Sequence; identical to SEQ ID NO: 30
  Synthetic Polypeptide

SEQ ID NO: 51 - protein, 118 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAIYYCAREGQWPYGMDVWGQGTTVTVSS

SEQ ID NO: 52 - protein, 108 aa, Artificial Sequence; identical to SEQ ID NO: 32
  Synthetic Polypeptide

SEQ ID NO: 53 - protein, 5 aa, Artificial Sequence
  Synthetic Polypeptide
RDDMH

SEQ ID NO: 54 - protein, 16 aa, Artificial Sequence
  Synthetic Polypeptide
GIDNAGETYYPGSVKG

SEQ ID NO: 55 - protein, 10 aa, Artificial Sequence
  Synthetic Polypeptide
EGQWPYGMDV

SEQ ID NO: 56 - protein, 11 aa, Artificial Sequence
  Synthetic Polypeptide
RASQGIRNDLG

SEQ ID NO: 57 - protein, 7 aa, Artificial Sequence
  Synthetic Polypeptide
SASSLQS

SEQ ID NO: 58 - protein, 9 aa, Artificial Sequence
  Synthetic Polypeptide
LQSNSYPLT

SEQ ID NO: 59 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREEFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 214 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHLNYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61 - protein, 117 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREEFGYGMDVWGQGTTVTVSS

SEQ ID NO: 62 - protein, 108 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHLNYPLTFGGGTKVEIKR

SEQ ID NO: 63 - protein, 5 aa, Artificial Sequence
  Synthetic Polypeptide
NYDMH

SEQ ID NO: 64 - protein, 16 aa, Artificial Sequence
  Synthetic Polypeptide
DIGNSGETYYLGSVKG

SEQ ID NO: 65 - protein, 9 aa, Artificial Sequence
  Synthetic Polypeptide
EEFGYGMDV

SEQ ID NO: 66 - protein, 11 aa, Artificial Sequence
  Synthetic Polypeptide
RASQGIRNDLG

SEQ ID NO: 67 - protein, 7 aa, Artificial Sequence
  Synthetic Polypeptide
AASSLQS

SEQ ID NO: 68 - protein, 9 aa, Artificial Sequence
  Synthetic Polypeptide
LQHLNYPLT

SEQ ID NO: 69 - protein, 447 aa, Artificial Sequence; identical to SEQ ID NO: 59
  Synthetic Polypeptide

SEQ ID NO: 70 - protein, 214 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHLDYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 71 - protein, 117 aa, Artificial Sequence; identical to SEQ ID NO: 61
  Synthetic Polypeptide

SEQ ID NO: 72 - protein, 108 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHLDYPLTFGGGTKVEIKR

SEQ ID NO: 73 - protein, 5 aa, Artificial Sequence
  Synthetic Polypeptide
NYDMH

SEQ ID NO: 74 - protein, 16 aa, Artificial Sequence
  Synthetic Polypeptide
DIGNSGETYYLGSVKG

SEQ ID NO: 75 - protein, 9 aa, Artificial Sequence
  Synthetic Polypeptide
EEFGYGMDV

SEQ ID NO: 76 - protein, 11 aa, Artificial Sequence
  Synthetic Polypeptide
RASQGIRNDLG

SEQ ID NO: 77 - protein, 7 aa, Artificial Sequence
  Synthetic Polypeptide
AASSLQS

SEQ ID NO: 78 - protein, 9 aa, Artificial Sequence
  Synthetic Polypeptide
LQHLDYPLT

SEQ ID NO: 79 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREEFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 214 aa, Artificial Sequence; identical to SEQ ID NO: 40
  Synthetic Polypeptide

SEQ ID NO: 81 - protein, 117 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREEFPHGMDVWGQGTTVTVSS

SEQ ID NO: 82 - protein, 108 aa, Artificial Sequence; identical to SEQ ID NO: 42
  Synthetic Polypeptide

SEQ ID NO: 83 - protein, 5 aa, Artificial Sequence
  Synthetic Polypeptide
NYDMH

SEQ ID NO: 84 - protein, 16 aa, Artificial Sequence
  Synthetic Polypeptide
DIGNSGETYYLGSVKG

SEQ ID NO: 85 - protein, 9 aa, Artificial Sequence
  Synthetic Polypeptide
EEFPHGMDV

SEQ ID NO: 86 - protein, 11 aa, Artificial Sequence
  Synthetic Polypeptide
RASQGIRNDLG

SEQ ID NO: 87 - protein, 7 aa, Artificial Sequence
  Synthetic Polypeptide
AASSLQS

SEQ ID NO: 88 - protein, 9 aa, Artificial Sequence
  Synthetic Polypeptide
LQHNSYPLT

SEQ ID NO: 89 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREEFPLGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 214 aa, Artificial Sequence; identical to SEQ ID NO: 40
  Synthetic Polypeptide

SEQ ID NO: 91 - protein, 117 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREEFPLGMDVWGQGTTVTVSS

SEQ ID NO: 92 - protein, 108 aa, Artificial Sequence; identical to SEQ ID NO: 42
  Synthetic Polypeptide

SEQ ID NO: 93 - protein, 5 aa, Artificial Sequence
  Synthetic Polypeptide
NYDMH

SEQ ID NO: 94 - protein, 16 aa, Artificial Sequence
  Synthetic Polypeptide
DIGNSGETYYLGSVKG

SEQ ID NO: 95 - protein, 9 aa, Artificial Sequence
  Synthetic Polypeptide
EEFPLGMDV

SEQ ID NO: 96 - protein, 11 aa, Artificial Sequence
  Synthetic Polypeptide
RASQGIRNDLG

SEQ ID NO: 97 - protein, 7 aa, Artificial Sequence
  Synthetic Polypeptide
AASSLQS

SEQ ID NO: 98 - protein, 9 aa, Artificial Sequence
  Synthetic Polypeptide
LQHNSYPLT

SEQ ID NO: 99 - protein, 459 aa, Artificial Sequence
  Synthetic Polypeptide
QVQLQESGPGLVKPSQTLSLTCTVSGGSISSGGYYWSWIRQHPGKGLEWIGYIYYSGSTSYNPSLKSRVTISVDTSKNQFSLKLSSVTAADTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 214 aa, Artificial Sequence
  Synthetic Polypeptide
EIVMTQSPATLSVSPGERATLSCRASQSVSNNLAWYQQKPGQAPRLLIYSESTRATGIPDRFSGSGSGTEFTLTISSLQSEDFAVYYCQQHNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 101 - protein, 129 aa, Artificial Sequence
  Synthetic Polypeptide
QVQLQESGPGLVKPSQTLSLTCTVSGGSISSGGYYWSWIRQHPGKGLEWIGYIYYSGSTSYNPSLKSRVTISVDTSKNQFSLKLSSVTAADTAVYYCARDLDYDILTGYPRWDYGMDVWGQGTTVTVSS

SEQ ID NO: 102 - protein, 108 aa, Artificial Sequence
  Synthetic Polypeptide
EIVMTQSPATLSVSPGERATLSCRASQSVSNNLAWYQQKPGQAPRLLIYSESTRATGIPDRFSGSGSGTEFTLTISSLQSEDFAVYYCQQHNNWPRTFGQGTKVEIKR

SEQ ID NO: 103 - protein, 7 aa, Artificial Sequence
  Synthetic Polypeptide
SGGYYWS

SEQ ID NO: 104 - protein, 16 aa, Artificial Sequence
  Synthetic Polypeptide
YIYYSGSTSYNPSLKS

SEQ ID NO: 105 - protein, 19 aa, Artificial Sequence
  Synthetic Polypeptide
DLDYDILTGYPRWDYGMDV

SEQ ID NO: 106 - protein, 11 aa, Artificial Sequence
  Synthetic Polypeptide
RASQSVSNNLA

SEQ ID NO: 107 - protein, 7 aa, Artificial Sequence
  Synthetic Polypeptide
SESTRAT

SEQ ID NO: 108 - protein, 9 aa, Artificial Sequence
  Synthetic Polypeptide
QQHNNWPRT

SEQ ID NO: 109 - protein, 452 aa, Artificial Sequence
  Synthetic Polypeptide
EVQLLESGGGLVQPGGSLRLSCAASGFTFSSYGMHWVRQAPGKGLEWVSLIWFDESNIYYADSVKGRFTISRDNAKNTLYLQMNSLRAEDTAVYFCARGYDLLTGYYNFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 216 aa, Artificial Sequence
  Synthetic Polypeptide
QAALTQPASVSGSPGQSITISCTGNANNVGNRGAAWLQQHPGKAPKLMIYRNNNRPSGVSNRFSASRSGNTASLTISGLQAEDEADYYCSAWDSSLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 111 - protein, 122 aa, Artificial Sequence
  Synthetic Polypeptide
EVQLLESGGGLVQPGGSLRLSCAASGFTFSSYGMHWVRQAPGKGLEWVSLIWFDESNIYYADSVKGRFTISRDNAKNTLYLQMNSLRAEDTAVYFCARGYDLLTGYYNFDFWGQGTLVTVSS

SEQ ID NO: 112 - protein, 111 aa, Artificial Sequence
  Synthetic Polypeptide
QAALTQPASVSGSPGQSITISCTGNANNVGNRGAAWLQQHPGKAPKLMIYRNNNRPSGVSNRFSASRSGNTASLTISGLQAEDEADYYCSAWDSSLSAWVFGGGTKLTVLG

SEQ ID NO: 113 - protein, 5 aa, Artificial Sequence
  Synthetic Polypeptide
SYGMH

SEQ ID NO: 114 - protein, 17 aa, Artificial Sequence
  Synthetic Polypeptide
LIWFDESNIYYADSVKG

SEQ ID NO: 115 - protein, 13 aa, Artificial Sequence
  Synthetic Polypeptide
GYDLLTGYYNFDF

SEQ ID NO: 116 - protein, 13 aa, Artificial Sequence
  Synthetic Polypeptide
TGNANNVGNRGAA

SEQ ID NO: 117 - protein, 7 aa, Artificial Sequence
  Synthetic Polypeptide
RNNNRPS

SEQ ID NO: 118 - protein, 11 aa, Artificial Sequence
  Synthetic Polypeptide
SAWDSSLSAWV

SEQ ID NO: 119 - protein, 453 aa, Artificial Sequence
  Synthetic Polypeptide
QVQLQESGPGLVKPSETLSLTCTVSGGSISSGGYYWNWIRQPPGKGLEWIGYIYGRGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 215 aa, Artificial Sequence
  Synthetic Polypeptide
EIVLTQSPGTLSLSPGERATLSCRASQPVASVYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 121 - protein, 123 aa, Artificial Sequence
  Synthetic Polypeptide
QVQLQESGPGLVKPSETLSLTCTVSGGSISSGGYYWNWIRQPPGKGLEWIGYIYGRGSTFYNPSLKSRVTISVDTSKNQFSLKLSSVTAADTAVYYCARAPRYNWNYGWFDPWGQGTLVTVSS

SEQ ID NO: 122 - protein, 109 aa, Artificial Sequence
  Synthetic Polypeptide
EIVLTQSPGTLSLSPGERATLSCRASQPVASVYLAWYQQKPGQAPRLLFYGASSRATGIPDRFSRSGSGTDFTLTISRLEPEDFAVYYCQQYDVSPWTFGQGTKVEIKR

SEQ ID NO: 123 - protein, 7 aa, Artificial Sequence
  Synthetic Polypeptide
SGGYYWN

SEQ ID NO: 124 - protein, 16 aa, Artificial Sequence
  Synthetic Polypeptide
YIYGRGSTFYNPSLKS

SEQ ID NO: 125 - protein, 13 aa, Artificial Sequence
  Synthetic Polypeptide
APRYNWNYGWFDP

SEQ ID NO: 126 - protein, 12 aa, Artificial Sequence
  Synthetic Polypeptide
RASQPVASVYLA

SEQ ID NO: 127 - protein, 7 aa, Artificial Sequence
  Synthetic Polypeptide
GASSRAT

SEQ ID NO: 128 - protein, 9 aa, Artificial Sequence
  Synthetic Polypeptide
QQYDVSPWT

SEQ ID NO: 129 - protein, 457 aa, Artificial Sequence
  Synthetic Polypeptide
QVQLQESGPGLVNPSQTLSLTCIVSGGSIRSGDYYWSWIRQHPGKGLEWIGYIYYSGGTYYNPSLKSRVIISVDTTKNQFSLKLSSMTAADTAVYYCARGSIAARSGYFYFSGLDVWGQGPTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 130 - protein, 219 aa, Artificial Sequence
  Synthetic Polypeptide
EIVLTQTPLSLSVTPGQPASISCKSSQSLLPSDGKTYLSWYLQKPGLPPQVLIYEVSNRFSGVPDRFSGSGSGTDFTLKISRVEAEDVGVYYCMQSIQLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 131 - protein, 127 aa, Artificial Sequence
  Synthetic Polypeptide
QVQLQESGPGLVNPSQTLSLTCIVSGGSIRSGDYYWSWIRQHPGKGLEWIGYIYYSGGTYYNPSLKSRVIISVDTTKNQFSLKLSSMTAADTAVYYCARGSIAARSGYFYFSGLDVWGQGPTVTVSS

SEQ ID NO: 132 - protein, 113 aa, Artificial Sequence
  Synthetic Polypeptide
EIVLTQTPLSLSVTPGQPASISCKSSQSLLPSDGKTYLSWYLQKPGLPPQVLIYEVSNRFSGVPDRFSGSGSGTDFTLKISRVEAEDVGVYYCMQSIQLPLTFGGGTKVEIKR

SEQ ID NO: 133 - protein, 7 aa, Artificial Sequence
  Synthetic Polypeptide
SGDYYWS

SEQ ID NO: 134 - protein, 16 aa, Artificial Sequence
  Synthetic Polypeptide
YIYYSGGTYYNPSLKS

SEQ ID NO: 135 - protein, 17 aa, Artificial Sequence
  Synthetic Polypeptide
GSIAARSGYFYFSGLDV

SEQ ID NO: 136 - protein, 16 aa, Artificial Sequence
  Synthetic Polypeptide
KSSQSLLPSDGKTYLS

SEQ ID NO: 137 - protein, 7 aa, Artificial Sequence
  Synthetic Polypeptide
EVSNRFS

SEQ ID NO: 138 - protein, 9 aa, Artificial Sequence
  Synthetic Polypeptide
MQSIQLPLT

SEQ ID NO: 139 - protein, 452 aa, Artificial Sequence
  Synthetic Polypeptide
QVQLVQSGAEVKKPGASVKVSCKASGYTFTSYYIHWVRQAPGQGLEWMGIINPSGGRTSYAQMFQGRVTLTRDTSTNTVYMELSSLRSEDTAVFYCAKDREEQWPVGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 140 - protein, 214 aa, Artificial Sequence
  Synthetic Polypeptide
DIQMTQSPSSLSASVGDRVTITCRASQNIRRYLNWYQQKPGKAPELLIYSASNLQNGVPSRFSGSGSGTDFTLTISSLQPEDFATYYCQQSYIIPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 141 - protein, 160 aa, Artificial Sequence
  Synthetic Polypeptide
QVQLVQSGAEVKKPGASVKVSCKASGYTFTSYYIHWVRQAPGQGLEWMGIINPSGGRTSYAQMFQGRVTLTRDTSTNTVYMELSSLRSEDTAVFYCAKDREEQWPVGGFDYWGQGTLVTVSSASTKGPSVFPLAPSSKSTSGGTAALGCLVKDYFPEPVT

SEQ ID NO: 142 - protein, 108 aa, Artificial Sequence
  Synthetic Polypeptide
DIQMTQSPSSLSASVGDRVTITCRASQNIRRYLNWYQQKPGKAPELLIYSASNLQNGVPSRFSGSGSGTDFTLTISSLQPEDFATYYCQQSYIIPPTFGQGTKVEIRR

SEQ ID NO: 143 - protein, 5 aa, Artificial Sequence
  Synthetic Polypeptide
SYYIH

SEQ ID NO: 144 - protein, 17 aa, Artificial Sequence
  Synthetic Polypeptide
IINPSGGRTSYAQMFQG

SEQ ID NO: 145 - protein, 13 aa, Artificial Sequence
  Synthetic Polypeptide
DREEQWPVGGFDY

SEQ ID NO: 146 - protein, 11 aa, Artificial Sequence
  Synthetic Polypeptide
RASQNIRRYLN

SEQ ID NO: 147 - protein, 7 aa, Artificial Sequence
  Synthetic Polypeptide
SASNLQN

SEQ ID NO: 148 - protein, 9 aa, Artificial Sequence
  Synthetic Polypeptide
QQSYIIPPT

SEQ ID NO: 149 - protein, 453 aa, Artificial Sequence
  Synthetic Polypeptide
QVQLQESGPGLVKPSETLFLTCTVSGGSVTNYYWSWIRQPAGKGLEWIGRIYTSGSTYYNPSLKSRVTMSLDTSKNQFSLRLSSVTAADTAVYYCAREGFTMVRGVMGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 150 - protein, 214 aa, Artificial Sequence
  Synthetic Polypeptide
DIQMTQSPSSLSASVGDRVTITCRASQSIRRYLNWYQQIPGKAPKFLIYDASSLQSGVPSRFSGSGSGTDFTLTISSLQPEDFATYYCQQSYSTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 151 - protein, 123 aa, Artificial Sequence
  Synthetic Polypeptide
QVQLQESGPGLVKPSETLFLTCTVSGGSVTNYYWSWIRQPAGKGLEWIGRIYTSGSTYYNPSLKSRVTMSLDTSKNQFSLRLSSVTAADTAVYYCAREGFTMVRGVMGAFDIWGQGTMVTVSS

SEQ ID NO: 152 - protein, 108 aa, Artificial Sequence
  Synthetic Polypeptide
DIQMTQSPSSLSASVGDRVTITCRASQSIRRYLNWYQQIPGKAPKFLIYDASSLQSGVPSRFSGSGSGTDFTLTISSLQPEDFATYYCQQSYSTPPTFGQGTKVEIKR

SEQ ID NO: 153 - protein, 5 aa, Artificial Sequence
  Synthetic Polypeptide
NYYWS

SEQ ID NO: 154 - protein, 16 aa, Artificial Sequence
  Synthetic Polypeptide
RIYTSGSTYYNPSLKS

SEQ ID NO: 155 - protein, 14 aa, Artificial Sequence
  Synthetic Polypeptide
EGFTMVRGVMGAFD

SEQ ID NO: 156 - protein, 11 aa, Artificial Sequence
  Synthetic Polypeptide
RASQSIRRYLN

SEQ ID NO: 157 - protein, 7 aa, Artificial Sequence
  Synthetic Polypeptide
DASSLQS

SEQ ID NO: 158 - protein, 9 aa, Artificial Sequence
  Synthetic Polypeptide
QQSYSTPPT

SEQ ID NO: 159 - protein, 452 aa, Artificial Sequence
  Synthetic Polypeptide
QVQLVQSGAEVKKPGASVKVSCKASGYTFTGYYIHWVRQAPGQGLEWMGWISPTSGATGYAQNFQGRVTMTRDTSITTAYMELSRLRSDDTAVYYCARDSNSVLYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 160 - protein, 214 aa, Artificial Sequence
  Synthetic Polypeptide
DIEMTQAPSSLSASVGDRVTITCRASQTIRRYLNWYQQKPGKAPKLLIYAASSLQNGVPSRFSGSVSGTDFTLTISSLQPEDFATYYCQQSYSTPLTFGGGTKVGIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 161 - protein, 122 aa, Artificial Sequence
  Synthetic Polypeptide
QVQLVQSGAEVKKPGASVKVSCKASGYTFTGYYIHWVRQAPGQGLEWMGWISPTSGATGYAQNFQGRVTMTRDTSITTAYMELSRLRSDDTAVYYCARDSNSVLYYYGMDVWGQGTTVTVSS

SEQ ID NO: 162 - protein, 108 aa, Artificial Sequence
  Synthetic Polypeptide
DIEMTQAPSSLSASVGDRVTITCRASQTIRRYLNWYQQKPGKAPKLLIYAASSLQNGVPSRFSGSVSGTDFTLTISSLQPEDFATYYCQQSYSTPLTFGGGTKVGIRR

SEQ ID NO: 163 - protein, 5 aa, Artificial Sequence
  Synthetic Polypeptide
GYYIH

SEQ ID NO: 164 - protein, 17 aa, Artificial Sequence
  Synthetic Polypeptide
WISPTSGATGYAQNFQG

SEQ ID NO: 165 - protein, 13 aa, Artificial Sequence
  Synthetic Polypeptide
DSNSVLYYYGMDV

SEQ ID NO: 166 - protein, 11 aa, Artificial Sequence
  Synthetic Polypeptide
RASQTIRRYLN

SEQ ID NO: 167 - protein, 7 aa, Artificial Sequence
  Synthetic Polypeptide
AASSLQN

SEQ ID NO: 168 - protein, 9 aa, Artificial Sequence
  Synthetic Polypeptide
QQSYSTPLT

SEQ ID NO: 169 - protein, 450 aa, Artificial Sequence
  Synthetic Polypeptide
QVQLQESGPGLVKPSQTLSLTCTVSGGSISSGGYYWSWIRQHPGKGLEWIGYIYYRGGTYYNPSLRSRVTMSVDTSKNQFSLMLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 170 - protein, 214 aa, Artificial Sequence
  Synthetic Polypeptide
DIQMTQSPSSLSASVGDRVTITCRSSQSISSYLNWYQQKPGRAPKLLIHAASSLQSGVPSRFSGSGSGTDFTLTISSLQPEDFASYCCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 171 - protein, 120 aa, Artificial Sequence
  Synthetic Polypeptide
QVQLQESGPGLVKPSQTLSLTCTVSGGSISSGGYYWSWIRQHPGKGLEWIGYIYYRGGTYYNPSLRSRVTMSVDTSKNQFSLMLSSVTAADTAVYYCARTIFGVIILDNWGQGTPVTVSS

SEQ ID NO: 172 - protein, 108 aa, Artificial Sequence
  Synthetic Polypeptide
DIQMTQSPSSLSASVGDRVTITCRSSQSISSYLNWYQQKPGRAPKLLIHAASSLQSGVPSRFSGSGSGTDFTLTISSLQPEDFASYCCQQSYTTPPTFGGGTKVEIKR

SEQ ID NO: 173 - protein, 7 aa, Artificial Sequence
  Synthetic Polypeptide
SGGYYWS

SEQ ID NO: 174 - protein, 16 aa, Artificial Sequence
  Synthetic Polypeptide
YIYYRGGTYYNPSLRS

SEQ ID NO: 175 - protein, 10 aa, Artificial Sequence
  Synthetic Polypeptide
TIFGVIILDN

SEQ ID NO: 176 - protein, 11 aa, Artificial Sequence
  Synthetic Polypeptide
RSSQSISSYLN

SEQ ID NO: 177 - protein, 7 aa, Artificial Sequence
  Synthetic Polypeptide
AASSLQS

SEQ ID NO: 178 - protein, 9 aa, Artificial Sequence
  Synthetic Polypeptide
QQSYTTPPT

SEQ ID NO: 179 - protein, 452 aa, Artificial Sequence
  Synthetic Polypeptide
QVQLVESGGGVVQPGRSLRLSCAASGFTFSSYGMHWVRQAPGKGLEWVALIWFDESNIYYADSVKGRFTISRDNSKNTLYLQMNSLRAEDTAVYFCARGYDLLTGYYNFDFWGLGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - protein, 216 aa, Artificial Sequence
  Synthetic Polypeptide
QAGLTQPPSVSKGLRQTATLTCTGNTNNVGNRGAAWLQQHQGHPPKLLSYRNNNRPSGISERLSASRSGNTASLTITGLQPEDEADYYCSAWDSSLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 181 - protein, 122 aa, Artificial Sequence
  Synthetic Polypeptide
QVQLVESGGGVVQPGRSLRLSCAASGFTFSSYGMHWVRQAPGKGLEWVALIWFDESNIYYADSVKGRFTISRDNSKNTLYLQMNSLRAEDTAVYFCARGYDLLTGYYNFDFWGLGTLVTVSA

SEQ ID NO: 182 - protein, 111 aa, Artificial Sequence
  Synthetic Polypeptide
QAGLTQPPSVSKGLRQTATLTCTGNTNNVGNRGAAWLQQHQGHPPKLLSYRNNNRPSGISERLSASRSGNTASLTITGLQPEDEADYYCSAWDSSLSAWVFGGGTKLTVLG

SEQ ID NO: 183 - protein, 5 aa, Artificial Sequence
  Synthetic Polypeptide
SYGMH

SEQ ID NO: 184 - protein, 17 aa, Artificial Sequence
  Synthetic Polypeptide
LIWFDESNIYYADSVKG

SEQ ID NO: 185 - protein, 13 aa, Artificial Sequence
  Synthetic Polypeptide
GYDLLTGYYNFDF

SEQ ID NO: 186 - protein, 13 aa, Artificial Sequence
  Synthetic Polypeptide
TGNTNNVGNRGAA

SEQ ID NO: 187 - protein, 7 aa, Artificial Sequence
  Synthetic Polypeptide
RNNNRPS

SEQ ID NO: 188 - protein, 11 aa, Artificial Sequence
  Synthetic Polypeptide
SAWDSSLSAWV

SEQ ID NO: 189 - protein, 457 aa, Artificial Sequence
  Synthetic Polypeptide
QVQLQESGPGLVKPSQTLSLTCTVSGGSISSVYFYWNWIRQHPGKGLEWIGYIYYSGGTYYNPSLRSRVTISVDTSKNQFSLKLNSVTAADTAVYYCARGSIAAGGGYFYYNDMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 190 - protein, 214 aa, Artificial Sequence
  Synthetic Polypeptide
EIVLTQSPDFQSVTPKEKVAITCRASQSIGSSLHWYQQKPDQSPKPLIKYVSQSFSGVPSRFSGSGSGTDFTLTINSLEAEDAATYYCHQSSSLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 191 - protein, 127 aa, Artificial Sequence
  Synthetic Polypeptide
QVQLQESGPGLVKPSQTLSLTCTVSGGSISSVYFYWNWIRQHPGKGLEWIGYIYYSGGTYYNPSLRSRVTISVDTSKNQFSLKLNSVTAADTAVYYCARGSIAAGGGYFYYNDMDVWGQGTTVTVSS

SEQ ID NO: 192 - protein, 108 aa, Artificial Sequence
  Synthetic Polypeptide
EIVLTQSPDFQSVTPKEKVAITCRASQSIGSSLHWYQQKPDQSPKPLIKYVSQSFSGVPSRFSGSGSGTDFTLTINSLEAEDAATYYCHQSSSLPLTFGGGTKVEIKR

SEQ ID NO: 193 - protein, 7 aa, Artificial Sequence
  Synthetic Polypeptide
SVYFYWN

SEQ ID NO: 194 - protein, 16 aa, Artificial Sequence
  Synthetic Polypeptide
YIYYSGGTYYNPSLRS

SEQ ID NO: 195 - protein, 17 aa, Artificial Sequence
  Synthetic Polypeptide
GSIAAGGGYFYYNDMDV

SEQ ID NO: 196 - protein, 11 aa, Artificial Sequence
  Synthetic Polypeptide
RASQSIGSSLH

SEQ ID NO: 197 - protein, 7 aa, Artificial Sequence
  Synthetic Polypeptide
YVSQSFS

SEQ ID NO: 198 - protein, 9 aa, Artificial Sequence
  Synthetic Polypeptide
HQSSSLPLT

SEQ ID NO: 199 - protein, 450 aa, Artificial Sequence
  Synthetic Polypeptide
QVQLQESGPGLVKPSETLSLTCTVSGGSISSGGYYWSWIRQHPGKGLEWIGYIYYRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - protein, 214 aa, Artificial Sequence
  Synthetic Polypeptide
DIQMTQSPSSLSASVGDRVTITCRSSQSISSYLNWYQQKPGRAPKLLIYAASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 201 - protein, 120 aa, Artificial Sequence
  Synthetic Polypeptide
QVQLQESGPGLVKPSETLSLTCTVSGGSISSGGYYWSWIRQHPGKGLEWIGYIYYRGGTYYNPSLRSRVTMSVDTSKNQFSLRLSSVTAADTAVYYCARTIFGVIILDNWGQGTPVTVSS

SEQ ID NO: 202 - protein, 108 aa, Artificial Sequence
  Synthetic Polypeptide
DIQMTQSPSSLSASVGDRVTITCRSSQSISSYLNWYQQKPGRAPKLLIYAASSLQSGVPSRFSGSGSGTDFTLTISSLQPEDFASYYCQQSYTTPPTFGGGTKVEIKR

SEQ ID NO: 203 - protein, 7 aa, Artificial Sequence
  Synthetic Polypeptide
SGGYYWS

SEQ ID NO: 204 - protein, 16 aa, Artificial Sequence
  Synthetic Polypeptide
YIYYRGGTYYNPSLRS

SEQ ID NO: 205 - protein, 10 aa, Artificial Sequence
  Synthetic Polypeptide
TIFGVIILDN

SEQ ID NO: 206 - protein, 11 aa, Artificial Sequence
  Synthetic Polypeptide
RSSQSISSYLN

SEQ ID NO: 207 - protein, 7 aa, Artificial Sequence
  Synthetic Polypeptide
AASSLQS

SEQ ID NO: 208 - protein, 9 aa, Artificial Sequence
  Synthetic Polypeptide
QQSYTTPPT

SEQ ID NO: 209 - protein, 453 aa, Artificial Sequence
  Synthetic Polypeptide
QVQLQESGPGLVKPSETLSLTCTVSGGSISSGGYYWNWIRQPPGKGLEWIGYIYYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 210 - protein, 215 aa, Artificial Sequence
  Synthetic Polypeptide
EIVLTQSPGTLSLSPGERATLSCRASQQVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 211 - protein, 123 aa, Artificial Sequence
  Synthetic Polypeptide
QVQLQESGPGLVKPSETLSLTCTVSGGSISSGGYYWNWIRQPPGKGLEWIGYIYYSGSTFYNPSLKSRVTISVDTSKNQFSLKLSSVTAADTAVYYCARAPRYNWNYGWFDPWGQGTLVTVSS

SEQ ID NO: 212 - protein, 109 aa, Artificial Sequence
  Synthetic Polypeptide
EIVLTQSPGTLSLSPGERATLSCRASQQVSSTYLAWYQQKPGQAPRLLFYGASSRATGIPDRFSRSGSGTDFTLTISRLEPEDFAVYYCQQYDVSPWTFGQGTKVEIKR

SEQ ID NO: 213 - protein, 7 aa, Artificial Sequence
  Synthetic Polypeptide
SGGYYWN

SEQ ID NO: 214 - protein, 16 aa, Artificial Sequence
  Synthetic Polypeptide
YIYYSGSTFYNPSLKS

SEQ ID NO: 215 - protein, 13 aa, Artificial Sequence
  Synthetic Polypeptide
APRYNWNYGWFDP

SEQ ID NO: 216 - protein, 12 aa, Artificial Sequence
  Synthetic Polypeptide
RASQQVSSTYLA

SEQ ID NO: 217 - protein, 7 aa, Artificial Sequence
  Synthetic Polypeptide
GASSRAT

SEQ ID NO: 218 - protein, 9 aa, Artificial Sequence
  Synthetic Polypeptide
QQYDVSPWT

SEQ ID NO: 219 - protein, 457 aa, Artificial Sequence
  Synthetic Polypeptide
QVQLQESGPGLVKPSETLSLTCTVSGGSISSVYFYWNWIRQPPGKGLEWIGYIYYSGGTYYNPSLRSRVTISVDTSKNQFSLKLNSVTAADTAVYYCARGSIAAGGGYFYYNDMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - protein, 214 aa, Artificial Sequence; identical to SEQ ID NO: 190
  Synthetic Polypeptide

SEQ ID NO: 221 - protein, 127 aa, Artificial Sequence
  Synthetic Polypeptide
QVQLQESGPGLVKPSETLSLTCTVSGGSISSVYFYWNWIRQPPGKGLEWIGYIYYSGGTYYNPSLRSRVTISVDTSKNQFSLKLNSVTAADTAVYYCARGSIAAGGGYFYYNDMDVWGQGTTVTVSS

SEQ ID NO: 222 - protein, 108 aa, Artificial Sequence; identical to SEQ ID NO: 192
  Synthetic Polypeptide

SEQ ID NO: 223 - protein, 7 aa, Artificial Sequence
  Synthetic Polypeptide
SVYFYWN

SEQ ID NO: 224 - protein, 16 aa, Artificial Sequence
  Synthetic Polypeptide
YIYYSGGTYYNPSLRS

SEQ ID NO: 225 - protein, 17 aa, Artificial Sequence
  Synthetic Polypeptide
GSIAAGGGYFYYNDMDV

SEQ ID NO: 226 - protein, 11 aa, Artificial Sequence
  Synthetic Polypeptide
RASQSIGSSLH

SEQ ID NO: 227 - protein, 7 aa, Artificial Sequence
  Synthetic Polypeptide
YVSQSFS

SEQ ID NO: 228 - protein, 9 aa, Artificial Sequence
  Synthetic Polypeptide
HQSSSLPLT

SEQ ID NO: 229 - protein, 448 aa, Artificial Sequence
  Synthetic Polypeptide
QVQLVESGGGVVQPGRSLRLSCAASGFTFSYYGMHWVRQAPGKGLEWVALISYDGNNKYYVDSVRGRFTISRDNSKNTLSLQMNSLRAEDTAVYYCAREIFGESYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 230 - protein, 214 aa, Artificial Sequence
  Synthetic Polypeptide
EIVMTQSPATLSVSPGERATLSCRASQSISRNLAWYQQKPGQAPRLLIYGASIRATVIPARFSGSGSGTEFTLTISSLQSEDFAIYYCQQYNNWMCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 231 - protein, 122 aa, Artificial Sequence
  Synthetic Polypeptide
QVQLVESGGGVVQPGRSLRLSCAASGFTFSYYGMHWVRQAPGKGLEWVALISYDGNNKYYVDSVRGRFTISRDNSKNTLSLQMNSLRAEDTAVYYCAREIFGESYYYGMDVWGQGTTVTVSS

SEQ ID NO: 232 - protein, 107 aa, Artificial Sequence
  Synthetic Polypeptide
EIVMTQSPATLSVSPGERATLSCRASQSISRNLAWYQQKPGQAPRLLIYGASIRATVIPARFSGSGSGTEFTLTISSLQSEDFAIYYCQQYNNWMCSFGQGTKLEIK

SEQ ID NO: 233 - protein, 5 aa, Artificial Sequence
  Synthetic Polypeptide
YYGMH

SEQ ID NO: 234 - protein, 17 aa, Artificial Sequence
  Synthetic Polypeptide
LISYDGNNKYYVDSVRG

SEQ ID NO: 235 - protein, 13 aa, Artificial Sequence
  Synthetic Polypeptide
EIFGESYYYGMDV

SEQ ID NO: 236 - protein, 11 aa, Artificial Sequence
  Synthetic Polypeptide
RASQSISRNLA

SEQ ID NO: 237 - protein, 7 aa, Artificial Sequence
  Synthetic Polypeptide
GASIRAT

SEQ ID NO: 238 - protein, 9 aa, Artificial Sequence
  Synthetic Polypeptide
QQYNNWMCS

SEQ ID NO: 239 - protein, 457 aa, Artificial Sequence
  Synthetic Polypeptide
  misc_feature (16)..(16): Xaa can be any naturally occurring amino acid
  misc_feature (42)..(42): Xaa can be any naturally occurring amino acid
  misc_feature (66)..(66): Xaa can be any naturally occurring amino acid
  misc_feature (85)..(85): Xaa can be any naturally occurring amino acid
QVQLQESGPGLVKPSXTLSLTCTVSGGSISSVYFYWNWIRQXPGKGLEWIGYIYYSGGTYYNPSLXSRVTISVDTSKNQFSLKLXSVTAADTAVYYCARGSIAAGGGYFYYNDMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - protein, 214 aa, Artificial Sequence
  Synthetic Polypeptide
  misc_feature (1)..(1): Xaa can be any naturally occurring amino acid
  misc_feature (3)..(4): Xaa can be any naturally occurring amino acid
  misc_feature (9)..(11): Xaa can be any naturally occurring amino acid
  misc_feature (13)..(22): Xaa can be any naturally occurring amino acid
  misc_feature (41)..(43): Xaa can be any naturally occurring amino acid
  misc_feature (45)..(46): Xaa can be any naturally occurring amino acid
  misc_feature (49)..(49): Xaa can be any naturally occurring amino acid
  misc_feature (58)..(58): Xaa can be any naturally occurring amino acid
  misc_feature (60)..(60): Xaa can be any naturally occurring amino acid
  misc_feature (76)..(76): Xaa can be any naturally occurring amino acid
  misc_feature (79)..(80): Xaa can be any naturally occurring amino acid
  misc_feature (83)..(83): Xaa can be any naturally occurring amino acid
  misc_feature (85)..(85): Xaa can be any naturally occurring amino acid
XIXXTQSPXXXSXXXXXXXXXXCRASQSIGSSLHWYQQKPXXXPXXLIXYVSQSFSGXPXRFSGSGSGTDFTLTIXSLXXEDXAXYYCHQSSSLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 241 - protein, 447 aa, Artificial Sequence
  Synthetic Polypeptide
  misc_feature (30)..(30): Xaa can be any naturally occurring amino acid
  misc_feature (32)..(32): Xaa can be any naturally occurring amino acid
  misc_feature (40)..(40): Xaa can be any naturally occurring amino acid
  misc_feature (57)..(58): Xaa can be any naturally occurring amino acid
  misc_feature (64)..(64): Xaa can be any naturally occurring amino acid
  misc_feature (66)..(66): Xaa can be any naturally occurring amino acid
  misc_feature (99)..(99): Xaa can be any naturally occurring amino acid
  misc_feature (101)..(102): Xaa can be any naturally occurring amino acid
  misc_feature (104)..(104): Xaa can be any naturally occurring amino acid
EVQLVESGGGLVQPGGSLRLSCAASGFTFXNXDMHWVRQXPGKGLEWVSDIGNSGEXXYLGSVXGXFTISRENAKNSLYLQMNSLRAGDTAVYYCVREXFXXGXDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - protein, 214 aa, Artificial Sequence
  Synthetic Polypeptide
  misc_feature (24)..(24): Xaa can be any naturally occurring amino acid
  misc_feature (31)..(31): Xaa can be any naturally occurring amino acid
  misc_feature (49)..(49): Xaa can be any naturally occurring amino acid
  misc_feature (92)..(93): Xaa can be any naturally occurring amino acid
DIQMTQSPSSLSASVGDRVTITCXASQGIRXDLGWYQQKPGKAPKRLIXAASSLQSGVPSRFSGSGSGTEFTLTISSLQPEDFATYYCLQHXXYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 243 - protein, 450 aa, Artificial Sequence
  Synthetic Polypeptide
  misc_feature (1)..(1): Xaa can be any naturally occurring amino acid
  misc_feature (5)..(6): Xaa can be any naturally occurring amino acid
  misc_feature (9)..(13): Xaa can be any naturally occurring amino acid
  misc_feature (15)..(21): Xaa can be any naturally occurring amino acid
  misc_feature (23)..(23): Xaa can be any naturally occurring amino acid
  misc_feature (33)..(33): Xaa can be any naturally occurring amino acid
  misc_feature (35)..(35): Xaa can be any naturally occurring amino acid
  misc_feature (42)..(42): Xaa can be any naturally occurring amino acid
  misc_feature (45)..(45): Xaa can be any naturally occurring amino acid
  misc_feature (50)..(51): Xaa can be any naturally occurring amino acid
  misc_feature (55)..(55): Xaa can be any naturally occurring amino acid
  misc_feature (64)..(69): Xaa can be any naturally occurring amino acid
  misc_feature (71)..(72): Xaa can be any naturally occurring amino acid
  misc_feature (79)..(79): Xaa can be any naturally occurring amino acid
  misc_feature (81)..(85): Xaa can be any naturally occurring amino acid
  misc_feature (87)..(90): Xaa can be any naturally occurring amino acid
  misc_feature (94)..(94): Xaa can be any naturally occurring amino acid
  misc_feature (104)..(105): Xaa can be any naturally occurring amino acid
  misc_feature (115)..(115): Xaa can be any naturally occurring amino acid
XVQLXXSGXXXXXPXXXXXXXCXVSGGSISSGXYXWSWIRQXPGXGLEWXXYIYXRGGTYYNPXXXXXXTXXVDTSKNXFXXXXXSXXXXDTAXYYCARTIFGXXILDNWGQGTXVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 244 - protein, 214 aa, Artificial Sequence
  Synthetic Polypeptide
  misc_feature (1)..(1): Xaa can be any naturally occurring amino acid
  misc_feature (3)..(3): Xaa can be any naturally occurring amino acid
  misc_feature (9)..(10): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(22): Xaa can be any naturally occurring amino acid
  misc_feature (24)..(24): Xaa can be any naturally occurring amino acid
  misc_feature (28)..(28): Xaa can be any naturally occurring amino acid
  misc_feature (30)..(31): Xaa can be any naturally occurring amino acid
  misc_feature (42)..(42): Xaa can be any naturally occurring amino acid
  misc_feature (45)..(45): Xaa can be any naturally occurring amino acid
  misc_feature (49)..(50): Xaa can be any naturally occurring amino acid
  misc_feature (52)..(56): Xaa can be any naturally occurring amino acid
  misc_feature (58)..(58): Xaa can be any naturally occurring amino acid
  misc_feature (60)..(60): Xaa can be any naturally occurring amino acid
  misc_feature (77)..(77): Xaa can be any naturally occurring amino acid
  misc_feature (79)..(79): Xaa can be any naturally occurring amino acid
  misc_feature (85)..(85): Xaa can be any naturally occurring amino acid
  misc_feature (87)..(87): Xaa can be any naturally occurring amino acid
  misc_feature (97)..(97): Xaa can be any naturally occurring amino acid
XIXMTQSPXXLSXSXGXRXTXXCXSSQXIXXYLNWYQQKPGXAPXLLIXXAXXXXXGXPXRFSGSGSGTDFTLTISXLXPEDFAXYXCQQSYTTPPXFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 245 - protein, 453 aa, Artificial Sequence
  Synthetic Polypeptide
  misc_feature (1)..(1): Xaa can be any naturally occurring amino acid
  misc_feature (28)..(32): Xaa can be any naturally occurring amino acid
  misc_feature (34)..(35): Xaa can be any naturally occurring amino acid
  misc_feature (37)..(37): Xaa can be any naturally occurring amino acid
  misc_feature (42)..(42): Xaa can be any naturally occurring amino acid
  misc_feature (52)..(56): Xaa can be any naturally occurring amino acid
  misc_feature (58)..(58): Xaa can be any naturally occurring amino acid
  misc_feature (60)..(60): Xaa can be any naturally occurring amino acid
  misc_feature (70)..(70): Xaa can be any naturally occurring amino acid
  misc_feature (105)..(107): Xaa can be any naturally occurring amino acid
XVQLQESGPGLVKPSETLSLTCTVSGGXXXXXGXXWXWIRQXPGKGLEWIGXXXXXGXTXYNPSLKSRVXISVDTSKNQFSLKLSSVTAADTAVYYCARAPRYNXXXGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 246 - protein, 215 aa, Artificial Sequence
  Synthetic Polypeptide
  misc_feature (24)..(30): Xaa can be any naturally occurring amino acid
  misc_feature (32)..(32): Xaa can be any naturally occurring amino acid
  misc_feature (34)..(34): Xaa can be any naturally occurring amino acid
  misc_feature (51)..(57): Xaa can be any naturally occurring amino acid
  misc_feature (65)..(65): Xaa can be any naturally occurring amino acid
  misc_feature (93)..(95): Xaa can be any naturally occurring amino acid
EIVLTQSPGTLSLSPGERATLSCXXXXXXXSXYXAWYQQKPGQAPRLLFYXXXXXXXGIPDRFSXSGSGTDFTLTISRLEPEDFAVYYCQQYXXXPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 247 - protein, 448 aa, Artificial Sequence
  Synthetic Polypeptide
  misc_feature (23)..(23): Xaa can be any naturally occurring amino acid
  misc_feature (31)..(33): Xaa can be any naturally occurring amino acid
  misc_feature (50)..(53): Xaa can be any naturally occurring amino acid
  misc_feature (55)..(55): Xaa can be any naturally occurring amino acid
  misc_feature (60)..(65): Xaa can be any naturally occurring amino acid
  misc_feature (103)..(103): Xaa can be any naturally occurring amino acid
QVQLVQSGAEVKKPGASVKVSCXASGYTFTXXXIYWVRQAPGQGLEWMGXXXXNXGGTNXXXXXXGRVTMTRDTSISTAYIELSRLRSDDTAVYYCAREDNFXGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 248 - protein, 214 aa, Artificial Sequence
  Synthetic Polypeptide
  misc_feature (25)..(27): Xaa can be any naturally occurring amino acid
  misc_feature (31)..(33): Xaa can be any naturally occurring amino acid
  misc_feature (52)..(56): Xaa can be any naturally occurring amino acid
  misc_feature (92)..(93): Xaa can be any naturally occurring amino acid
DIQMTQSPSSLSASVGDRVTITCRXXXGIRXXXGWYQQKPGKAPKRLIYAAXXXXXGVPSRFSGSGSGTEFTLTISSLQPEDFATYYCLQLXXYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 249 - protein, 448 aa, Artificial Sequence
  Synthetic Polypeptide
  misc_feature (33)..(34): Xaa can be any naturally occurring amino acid
  misc_feature (52)..(52): Xaa can be any naturally occurring amino acid
  misc_feature (56)..(56): Xaa can be any naturally occurring amino acid
  misc_feature (58)..(58): Xaa can be any naturally occurring amino acid
  misc_feature (62)..(62): Xaa can be any naturally occurring amino acid
  misc_feature (64)..(64): Xaa can be any naturally occurring amino acid
  misc_feature (66)..(66): Xaa can be any naturally occurring amino acid
  misc_feature (92)..(92): Xaa can be any naturally occurring amino acid
  misc_feature (100)..(101): Xaa can be any naturally occurring amino acid
  misc_feature (103)..(103): Xaa can be any naturally occurring amino acid
  misc_feature (105)..(106): Xaa can be any naturally occurring amino acid
EVQLVESGGGLVQPGGSLRLSCAASGFTFSRDXXHWVRQATGKGLEWVAGIXNAGXTXYPGXVXGXFTISRENAKNSLYLQMNSLRAGDTAXYYCAREGXXPXGXXVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 250 - protein, 214 aa, Artificial Sequence
  Synthetic Polypeptide
  misc_feature (24)..(24): Xaa can be any naturally occurring amino acid
  misc_feature (30)..(30): Xaa can be any naturally occurring amino acid
  misc_feature (59)..(59): Xaa can be any naturally occurring amino acid
  misc_feature (92)..(94): Xaa can be any naturally occurring amino acid
DIQMTQSPSSLSASVGDRVTITCXASQGIXNDLGWYQQKPGKAPKRLIYSASSLQSGVXSRFSGSGSGTEFTLTISSLQPEDFATYYCLQSXXXPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 251 - protein, 459 aa, Artificial Sequence
  Synthetic Polypeptide
  misc_feature (1)..(1): Xaa can be any naturally occurring amino acid
  misc_feature (5)..(6): Xaa can be any naturally occurring amino acid
  misc_feature (9)..(12): Xaa can be any naturally occurring amino acid
  misc_feature (15)..(21): Xaa can be any naturally occurring amino acid
  misc_feature (23)..(24): Xaa can be any naturally occurring amino acid
  misc_feature (28)..(29): Xaa can be any naturally occurring amino acid
  misc_feature (34)..(34): Xaa can be any naturally occurring amino acid
  misc_feature (39)..(39): Xaa can be any naturally occurring amino acid
  misc_feature (42)..(42): Xaa can be any naturally occurring amino acid
  misc_feature (45)..(45): Xaa can be any naturally occurring amino acid
  misc_feature (50)..(54): Xaa can be any naturally occurring amino acid
  misc_feature (58)..(62): Xaa can be any naturally occurring amino acid
  misc_feature (64)..(69): Xaa can be any naturally occurring amino acid
  misc_feature (72)..(73): Xaa can be any naturally occurring amino acid
  misc_feature (75)..(75): Xaa can be any naturally occurring amino acid
  misc_feature (77)..(90): Xaa can be any naturally occurring amino acid
  misc_feature (94)..(94): Xaa can be any naturally occurring amino acid
  misc_feature (106)..(109): Xaa can be any naturally occurring amino acid
  misc_feature (112)..(112): Xaa can be any naturally occurring amino acid
  misc_feature (116)..(116): Xaa can be any naturally occurring amino acid
XVQLXXSGXXXXKPXXXXXXXCXXSGGXXSSGGXYWSWXRQXPGXGLEWXXXXXYSGXXXXXPXXXXXXTIXXDXSXXXXXXXXXXXXXXDTAXYYCARDLDYDIXXXXPRXDYGXDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 252 - protein, 214 aa, Artificial Sequence
  Synthetic Polypeptide
  misc_feature (1)..(1): Xaa can be any naturally occurring amino acid
  misc_feature (3)..(3): Xaa can be any naturally occurring amino acid
  misc_feature (9)..(9): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(22): Xaa can be any naturally occurring amino acid
  misc_feature (24)..(26): Xaa can be any naturally occurring amino acid
  misc_feature (28)..(29): Xaa can be any naturally occurring amino acid
  misc_feature (42)..(42): Xaa can be any naturally occurring amino acid
  misc_feature (45)..(45): Xaa can be any naturally occurring amino acid
  misc_feature (54)..(54): Xaa can be any naturally occurring amino acid
  misc_feature (56)..(56): Xaa can be any naturally occurring amino acid
  misc_feature (58)..(58): Xaa can be any naturally occurring amino acid
  misc_feature (60)..(60): Xaa can be any naturally occurring amino acid
  misc_feature (80)..(81): Xaa can be any naturally occurring amino acid
  misc_feature (85)..(85): Xaa can be any naturally occurring amino acid
  misc_feature (90)..(94): Xaa can be any naturally occurring amino acid
XIXMTQSPXTLSXSXGXRXTXXCXXXQXXSNNLAWYQQKPGXAPXLLIYSESTXAXGXPXRFSGSGSGTEFTLTISSLQXXDFAXYYCQXXXXXPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 253 - protein, 457 aa, Artificial Sequence
  Synthetic Polypeptide
  misc_feature (13)..(13): Xaa can be any naturally occurring amino acid
  misc_feature (16)..(16): Xaa can be any naturally occurring amino acid
  misc_feature (30)..(30): Xaa can be any naturally occurring amino acid
  misc_feature (42)..(42): Xaa can be any naturally occurring amino acid
  misc_feature (70)..(70): Xaa can be any naturally occurring amino acid
  misc_feature (121)..(121): Xaa can be any naturally occurring amino acid
QVQLQESGPGLVXPSXTLSLTCIVSGGSIXSGDYYWSWIRQXPGKGLEWIGYIYYSGGTYYNPSLKSRVXISVDTTKNQFSLKLSSMTAADTAVYYCARGSIAARSGYFYFSGLDVWGQGXTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 254 - protein, 219 aa, Artificial Sequence
  Synthetic Polypeptide
  misc_feature (33)..(34): Xaa can be any naturally occurring amino acid
  misc_feature (47)..(48): Xaa can be any naturally occurring amino acid
  misc_feature (105)..(105): Xaa can be any naturally occurring amino acid
EIVLTQTPLSLSVTPGQPASISCKSSQSLLPSXXKTYLSWYLQKPGXXPQVLIYEVSNRFSGVPDRFSGSGSGTDFTLKISRVEAEDVGVYYCMQSIQLPLTFGXGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 255 - protein, 453 aa, Artificial Sequence
  Synthetic Polypeptide
  misc_feature (19)..(19): Xaa can be any naturally occurring amino acid
QVQLQESGPGLVKPSETLXLTCTVSGGSVTNYYWSWIRQPAGKGLEWIGRIYTSGSTYYNPSLKSRVTMSLDTSKNQFSLRLSSVTAADTAVYYCAREGFTMVRGVMGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 256 - protein, 214 aa, Artificial Sequence
  Synthetic Polypeptide
  misc_feature (39)..(39): Xaa can be any naturally occurring amino acid
  misc_feature (46)..(46): Xaa can be any naturally occurring amino acid
DIQMTQSPSSLSASVGDRVTITCRASQSIRRYLNWYQQXPGKAPKXLIYDASSLQSGVPSRFSGSGSGTDFTLTISSLQPEDFATYYCQQSYSTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 257 - protein, 452 aa, Artificial Sequence
  Synthetic Polypeptide
  misc_feature (1)..(1): Xaa can be any naturally occurring amino acid
  misc_feature (5)..(6): Xaa can be any naturally occurring amino acid
  misc_feature (9)..(13): Xaa can be any naturally occurring amino acid
  misc_feature (16)..(16): Xaa can be any naturally occurring amino acid
  misc_feature (18)..(20): Xaa can be any naturally occurring amino acid
  misc_feature (23)..(23): Xaa can be any naturally occurring amino acid
  misc_feature (43)..(43): Xaa can be any naturally occurring amino acid
  misc_feature (48)..(49): Xaa can be any naturally occurring amino acid
  misc_feature (63)..(65): Xaa can be any naturally occurring amino acid
  misc_feature (68)..(68): Xaa can be any naturally occurring amino acid
  misc_feature (71)..(71): Xaa can be any naturally occurring amino acid
  misc_feature (75)..(75): Xaa can be any naturally occurring amino acid
  misc_feature (81)..(84): Xaa can be any naturally occurring amino acid
  misc_feature (88)..(88): Xaa can be any naturally occurring amino acid
  misc_feature (95)..(95): Xaa can be any naturally occurring amino acid
  misc_feature (114)..(114): Xaa can be any naturally occurring amino acid
  misc_feature (122)..(122): Xaa can be any naturally occurring amino acid
XVQLXXSGXXXXXPGXSXXXSCXASGFTFSSYGMHWVRQAPGXGLEWXXLIWFDESNIYYADXXXGRXTIXRDNXKNTLYXXXXSLRXEDTAVYXCARGYDLLTGYYNFDFWGXGTLVTVSXASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 258 - protein, 216 aa, Artificial Sequence
  Synthetic Polypeptide
  misc_feature (3)..(3): Xaa can be any naturally occurring amino acid
  misc_feature (8)..(8): Xaa can be any naturally occurring amino acid
  misc_feature (12)..(15): Xaa can be any naturally occurring amino acid
  misc_feature (17)..(18): Xaa can be any naturally occurring amino acid
  misc_feature (20)..(21): Xaa can be any naturally occurring amino acid
  misc_feature (25)..(26): Xaa can be any naturally occurring amino acid
  misc_feature (41)..(41): Xaa can be any naturally occurring amino acid
  misc_feature (43)..(44): Xaa can be any naturally occurring amino acid
  misc_feature (48)..(49): Xaa can be any naturally occurring amino acid
  misc_feature (59)..(59): Xaa can be any naturally occurring amino acid
  misc_feature (61)..(61): Xaa can be any naturally occurring amino acid
  misc_feature (63)..(63): Xaa can be any naturally occurring amino acid
  misc_feature (77)..(77): Xaa can be any naturally occurring amino acid
  misc_feature (81)..(81): Xaa can be any naturally occurring amino acid
  misc_feature (92)..(92): Xaa can be any naturally occurring amino acid
  misc_feature (94)..(94): Xaa can be any naturally occurring amino acid
QAXLTQPXSVSXXXXQXXTXXCTGXXNNVGNRGAAWLQQHXGXXPKLXXYRNNNRPSGXSXRXSASRSGNTASLTIXGLQXEDEADYYCSAXDXSLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 259 - protein, 452 aa, Artificial Sequence
  Synthetic Polypeptide
  misc_feature (104)..(104): Xaa can be any naturally occurring amino acid
QVQLVQSGAEVKKPGASVKVSCKASGYTFTSYYIHWVRQAPGQGLEWMGIINPSGGRTSYAQMFQGRVTLTRDTSTNTVYMELSSLRSEDTAVFYCAKDREEQXPVGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 260 - protein, 214 aa, Artificial Sequence
  Synthetic Polypeptide
  misc_feature (45)..(45): Xaa can be any naturally occurring amino acid
  misc_feature (56)..(57): Xaa can be any naturally occurring amino acid
DIQMTQSPSSLSASVGDRVTITCRASQNIRRYLNWYQQKPGKAPXLLIYSASNLQXXVPSRFSGSGSGTDFTLTISSLQPEDFATYYCQQSYIIPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 261 - protein, 452 aa, Artificial Sequence
  Synthetic Polypeptide
  misc_feature (85)..(85): Xaa can be any naturally occurring amino acid
  misc_feature (100)..(100): Xaa can be any naturally occurring amino acid
QVQLVQSGAEVKKPGASVKVSCKASGYTFTGYYIHWVRQAPGQGLEWMGWISPTSGATGYAQNFQGRVTMTRDTSITTAYMELSXLRSDDTAVYYCARDXNSVLYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 262 - protein, 214 aa, Artificial Sequence
  Synthetic Polypeptide
  misc_feature (7)..(7): Xaa can be any naturally occurring amino acid
  misc_feature (56)..(57): Xaa can be any naturally occurring amino acid
  misc_feature (66)..(66): Xaa can be any naturally occurring amino acid
  misc_feature (105)..(105): Xaa can be any naturally occurring amino acid
DIEMTQXPSSLSASVGDRVTITCRASQTIRRYLNWYQQKPGKAPKLLIYAASSLQXXVPSRFSGSXSGTDFTLTISSLQPEDFATYYCQQSYSTPLTFGGGTKVXIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 263 - protein, 452 aa, Artificial Sequence
  Synthetic Polypeptide
QVQLVESGGGVVQPGRSLRLSCAASGFTFSYYGMHWVRQAPGKGLEWVALISYHGNNKYYVRNVRGRFTISRDNSKNTLSLQMNSLRAEDTAVYYCAREIFGGSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 264 - protein, 214 aa, Artificial Sequence
  Synthetic Polypeptide
  misc_feature (96)..(96): Xaa can be any naturally occurring amino acid
EIVMTQSPATLSVSPGERATLSCRASQSISRNLAWYQQKPGQAPRLLIYGASIRATVIPARFSGSGSGTEFTLTISSLQSEDFAVYYCQQYNNFHXSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 265 - protein, 214 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQLQSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 266 - protein, 448 aa, Artificial Sequence; identical to SEQ ID NO: 9
  Synthetic Polypeptide

SEQ ID NO: 267 - protein, 214 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQLLSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 268 - protein, 448 aa, Artificial Sequence; identical to SEQ ID NO: 9
  Synthetic Polypeptide

SEQ ID NO: 269 - protein, 214 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQLSSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 270 - protein, 448 aa, Artificial Sequence; identical to SEQ ID NO: 9
  Synthetic Polypeptide

SEQ ID NO: 271 - protein, 214 aa, Artificial Sequence; identical to SEQ ID NO: 20
  Synthetic Polypeptide

SEQ ID NO: 272 - protein, 448 aa, Artificial Sequence; identical to SEQ ID NO: 9
  Synthetic Polypeptide

SEQ ID NO: 273 - protein, 214 aa, Artificial Sequence; identical to SEQ ID NO: 265
  Synthetic Polypeptide

SEQ ID NO: 274 - protein, 448 aa, Artificial Sequence
  Synthetic Polypeptide
QVQLVQSGAEVKKPGASVKVSCKASGYTFTDYYIYWVRQAPGQGLEWMGWINPNSGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 275 - protein, 214 aa, Artificial Sequence; identical to SEQ ID NO: 267
  Synthetic Polypeptide

SEQ ID NO: 276 - protein, 448 aa, Artificial Sequence; identical to SEQ ID NO: 274
  Synthetic Polypeptide

SEQ ID NO: 277 - protein, 214 aa, Artificial Sequence; identical to SEQ ID NO: 269
  Synthetic Polypeptide

SEQ ID NO: 278 - protein, 448 aa, Artificial Sequence; identical to SEQ ID NO: 274
  Synthetic Polypeptide

SEQ ID NO: 279 - protein, 214 aa, Artificial Sequence; identical to SEQ ID NO: 20
  Synthetic Polypeptide

SEQ ID NO: 280 - protein, 448 aa, Artificial Sequence; identical to SEQ ID NO: 274
  Synthetic Polypeptide

SEQ ID NO: 281 - protein, 214 aa, Artificial Sequence; identical to SEQ ID NO: 265
  Synthetic Polypeptide

SEQ ID NO: 282 - protein, 448 aa, Artificial Sequence
  Synthetic Polypeptide
QVQLVQSGAEVKKPGASVKVSCQASGYTFTDYYIYWVRQAPGQGLEWMGWINPNAGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 283 - protein, 214 aa, Artificial Sequence; identical to SEQ ID NO: 267
  Synthetic Polypeptide

SEQ ID NO: 284 - protein, 448 aa, Artificial Sequence; identical to SEQ ID NO: 282
  Synthetic Polypeptide

SEQ ID NO: 285 - protein, 214 aa, Artificial Sequence; identical to SEQ ID NO: 269
  Synthetic Polypeptide

SEQ ID NO: 286 - protein, 448 aa, Artificial Sequence; identical to SEQ ID NO: 282
  Synthetic Polypeptide

SEQ ID NO: 287 - protein, 214 aa, Artificial Sequence; identical to SEQ ID NO: 20
  Synthetic Polypeptide

SEQ ID NO: 288 - protein, 448 aa, Artificial Sequence; identical to SEQ ID NO: 282
  Synthetic Polypeptide

SEQ ID NO: 289 - protein, 214 aa, Artificial Sequence; identical to SEQ ID NO: 265
  Synthetic Polypeptide

SEQ ID NO: 290 - protein, 448 aa, Artificial Sequence; identical to SEQ ID NO: 19
  Synthetic Polypeptide

SEQ ID NO: 291 - protein, 214 aa, Artificial Sequence; identical to SEQ ID NO: 267
  Synthetic Polypeptide

SEQ ID NO: 292 - protein, 448 aa, Artificial Sequence; identical to SEQ ID NO: 19
  Synthetic Polypeptide

SEQ ID NO: 293 - protein, 214 aa, Artificial Sequence; identical to SEQ ID NO: 269
  Synthetic Polypeptide

SEQ ID NO: 294 - protein, 448 aa, Artificial Sequence; identical to SEQ ID NO: 19
  Synthetic Polypeptide

SEQ ID NO: 295 - protein, 214 aa, Artificial Sequence; identical to SEQ ID NO: 265
  Synthetic Polypeptide

SEQ ID NO: 296 - protein, 448 aa, Artificial Sequence
  Synthetic Polypeptide
QVQLVQSGAEVKKPGASVKVSCQASGYTFTDYYIYWVRQAPGQGLEWMGWINPNSGGTNYAQKFQGRVTMTRDTSISTAYIELSRLRSDDTAVYYCAREDNFQGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - protein, 214 aa, Artificial Sequence; identical to SEQ ID NO: 267
  Synthetic Polypeptide

SEQ ID NO: 298 - protein, 448 aa, Artificial Sequence; identical to SEQ ID NO: 296
  Synthetic Polypeptide

SEQ ID NO: 299 - protein, 214 aa, Artificial Sequence; identical to SEQ ID NO: 269
  Synthetic Polypeptide

SEQ ID NO: 300 - protein, 448 aa, Artificial Sequence; identical to SEQ ID NO: 296
  Synthetic Polypeptide

SEQ ID NO: 301 - protein, 214 aa, Artificial Sequence; identical to SEQ ID NO: 20
  Synthetic Polypeptide

SEQ ID NO: 302 - protein, 448 aa, Artificial Sequence; identical to SEQ ID NO: 296
  Synthetic Polypeptide

SEQ ID NO: 303 - protein, 214 aa, Artificial Sequence; identical to SEQ ID NO: 265
  Synthetic Polypeptide

SEQ ID NO: 304 - protein, 448 aa, Artificial Sequence
  Synthetic Polypeptide
QVQLVQSGAEVKKPGASVKVSCKASGYTFTDYYIYWVRQAPGQGLEWMGWINPNSGGTNYAQKFQGRVTMTRDTSISTAYIELSRLRSDDTAVYYCAREDNFQGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - protein, 214 aa, Artificial Sequence; identical to SEQ ID NO: 267
  Synthetic Polypeptide

SEQ ID NO: 306 - protein, 448 aa, Artificial Sequence; identical to SEQ ID NO: 304
  Synthetic Polypeptide

SEQ ID NO: 307 - protein, 214 aa, Artificial Sequence; identical to SEQ ID NO: 269
  Synthetic Polypeptide

SEQ ID NO: 308 - protein, 448 aa, Artificial Sequence; identical to SEQ ID NO: 304
  Synthetic Polypeptide

SEQ ID NO: 309 - protein, 214 aa, Artificial Sequence; identical to SEQ ID NO: 20
  Synthetic Polypeptide

SEQ ID NO: 310 - protein, 448 aa, Artificial Sequence; identical to SEQ ID NO: 304
  Synthetic Polypeptide

SEQ ID NO: 311 - protein, 214 aa, Artificial Sequence; identical to SEQ ID NO: 265
  Synthetic Polypeptide

SEQ ID NO: 312 - protein, 448 aa, Artificial Sequence
  Synthetic Polypeptide
QVQLVQSGAEVKKPGASVKVSCQASGYTFTDYYIYWVRQAPGQGLEWMGWINPNAGGTNYAQKFQGRVTMTRDTSISTAYIELSRLRSDDTAVYYCAREDNFQGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 313 - protein, 214 aa, Artificial Sequence; identical to SEQ ID NO: 267
  Synthetic Polypeptide

SEQ ID NO: 314 - protein, 448 aa, Artificial Sequence; identical to SEQ ID NO: 312
  Synthetic Polypeptide

SEQ ID NO: 315 - protein, 214 aa, Artificial Sequence; identical to SEQ ID NO: 269
  Synthetic Polypeptide

SEQ ID NO: 316 - protein, 448 aa, Artificial Sequence; identical to SEQ ID NO: 312
  Synthetic Polypeptide

SEQ ID NO: 317 - protein, 214 aa, Artificial Sequence; identical to SEQ ID NO: 20
  Synthetic Polypeptide

SEQ ID NO: 318 - protein, 448 aa, Artificial Sequence; identical to SEQ ID NO: 312
  Synthetic Polypeptide

SEQ ID NO: 319 - protein, 214 aa, Artificial Sequence; identical to SEQ ID NO: 265
  Synthetic Polypeptide

SEQ ID NO: 320 - protein, 448 aa, Artificial Sequence
  Synthetic Polypeptide
QVQLVQSGAEVKKPGASVKVSCKASGYTFTDYYIYWVRQAPGQGLEWMGWINPNAGGTNYAQKFQGRVTMTRDTSISTAYIELSRLRSDDTAVYYCAREDNFQGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 321 - protein, 214 aa, Artificial Sequence; identical to SEQ ID NO: 267
  Synthetic Polypeptide

SEQ ID NO: 322 - protein, 448 aa, Artificial Sequence; identical to SEQ ID NO: 320
  Synthetic Polypeptide

SEQ ID NO: 323 - protein, 214 aa, Artificial Sequence; identical to SEQ ID NO: 269
  Synthetic Polypeptide

SEQ ID NO: 324 - protein, 448 aa, Artificial Sequence; identical to SEQ ID NO: 320
  Synthetic Polypeptide

SEQ ID NO: 325 - protein, 214 aa, Artificial Sequence; identical to SEQ ID NO: 20
  Synthetic Polypeptide

SEQ ID NO: 326 - protein, 448 aa, Artificial Sequence; identical to SEQ ID NO: 320
  Synthetic Polypeptide

SEQ ID NO: 327 - protein, 214 aa, Artificial Sequence; identical to SEQ ID NO: 10
  Synthetic Polypeptide

SEQ ID NO: 328 - protein, 448 aa, Artificial Sequence
  Synthetic Polypeptide
QVQLVQSGAEVKKPGASVKVSCQASGYTFTDYYIYWVRQAPGQGLEWMGYINPNSGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 329 - protein, 214 aa, Artificial Sequence; identical to SEQ ID NO: 10
  Synthetic Polypeptide

SEQ ID NO: 330 - protein, 448 aa, Artificial Sequence
  Synthetic Polypeptide
QVQLVQSGAEVKKPGASVKVSCQASGYTFTDYYIYWVRQAPGQGLEWMGFINPNSGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 331 - protein, 214 aa, Artificial Sequence; identical to SEQ ID NO: 10
  Synthetic Polypeptide

SEQ ID NO: 332 - protein, 448 aa, Artificial Sequence
  Synthetic Polypeptide
QVQLVQSGAEVKKPGASVKVSCQASGYTFTDYYIYWVRQAPGQGLEWMGWINPQSGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 333 - protein, 214 aa, Artificial Sequence; identical to SEQ ID NO: 265
  Synthetic Polypeptide

SEQ ID NO: 334 - protein, 448 aa, Artificial Sequence
  Synthetic Polypeptide
QVQLVQSGAEVKKPGASVKVSCKASGYTFTDYYIYWVRQAPGQGLEWMGWINPQSGGTNYAQKFQGRVTMTRDTSISTAYIELSRLRSDDTAVYYCAREDNFQGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 335 - protein, 214 aa, Artificial Sequence; identical to SEQ ID NO: 20
  Synthetic Polypeptide

SEQ ID NO: 336 - protein, 448 aa, Artificial Sequence; identical to SEQ ID NO: 334
  Synthetic Polypeptide

SEQ ID NO: 337 - protein, 214 aa, Artificial Sequence
  Synthetic Polypeptide
EIVMTQSPATLSVSPGERATLSCRASQSVSNNLAWYQQKPGQAPRLLIYSESTRATGIPDRFSGSGSGTEFTLTISSLQSEDFAVYYCQQHNNNPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 338 - protein, 459 aa, Artificial Sequence; identical to SEQ ID NO: 99
  Synthetic Polypeptide

SEQ ID NO: 339 - protein, 214 aa, Artificial Sequence
  Synthetic Polypeptide
EIVMTQSPATLSVSPGERATLSCRASQSVSNNLAWYQQKPGQAPRLLIYSESTRATGIPDRFSGSGSGTEFTLTISSLQSEDFAVYYCQQHNNHPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 340 - protein, 459 aa, Artificial Sequence; identical to SEQ ID NO: 99
  Synthetic Polypeptide

SEQ ID NO: 341 - protein, 214 aa, Artificial Sequence
  Synthetic Polypeptide
EIVMTQSPATLSVSPGERATLSCRASQSVSNNLAWYQQKPGQAPRLLIYSESTRATGIPDRFSGSGSGTEFTLTISSLQSEDFAVYYCQQHNNLPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 342 - protein, 459 aa, Artificial Sequence; identical to SEQ ID NO: 99
  Synthetic Polypeptide

SEQ ID NO: 343 - protein, 214 aa, Artificial Sequence; identical to SEQ ID NO: 100
  Synthetic Polypeptide

SEQ ID NO: 344 - protein, 459 aa, Artificial Sequence
  Synthetic Polypeptide
QVQLQESGPGLVKPSQTLSLTCTVSGGSISSGGYYWSWIRQHPGKGLEWIGYIYYSGSTSYNPSLKSRVTISVDTSKNQFSLKLSSVTAADTAVYYCARDLDYDILTGYPRYDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 345 - protein, 214 aa, Artificial Sequence; identical to SEQ ID NO: 100
  Synthetic Polypeptide

SEQ ID NO: 346 - protein, 459 aa, Artificial Sequence
  Synthetic Polypeptide
QVQLQESGPGLVKPSQTLSLTCTVSGGSISSGGYYWSWIRQHPGKGLEWIGYIYYSGSTSYNPSLKSRVTISVDTSKNQFSLKLSSVTAADTAVYYCARDLDYDILTGYPRFDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 347 - protein, 214 aa, Artificial Sequence; identical to SEQ ID NO: 100
  Synthetic Polypeptide

SEQ ID NO: 348 - protein, 459 aa, Artificial Sequence
  Synthetic Polypeptide
QVQLQESGPGLVKPSQTLSLTCTVSGGSISSGGYYWSWIRQHPGKGLEWIGYIYYSGSTSYNPSLKSRVTISVDTSKNQFSLKLSSVTAADTAVYYCARDLDYDILTGYPRHDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 349 - protein, 214 aa, Artificial Sequence; identical to SEQ ID NO: 100
  Synthetic Polypeptide

SEQ ID NO: 350 - protein, 459 aa, Artificial Sequence
  Synthetic Polypeptide
QVQLQESGPGLVKPSQTLSLTCTVSGGSISSGGYYWSWIRQHPGKGLEWIGYIYYSGSTSYNPSLKSRVTISVDTSKNQFSLKLSSVTAADTAVYYCARDLDYDILTGYPRLDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 351 - protein, 214 aa, Artificial Sequence; identical to SEQ ID NO: 100
  Synthetic Polypeptide

SEQ ID NO: 352 - protein, 459 aa, Artificial Sequence
  Synthetic Polypeptide
QVQLQESGPGLVKPSQTLSLTCTVSGGSISSGGYYWSWIRQHPGKGLEWIGYIYYSGSTSYNPSLKSRVTISVDTSKNQFSLKLSSVTAADTAVYYCARDLDYDILTGYPRSDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 353 - protein, 214 aa, Artificial Sequence; identical to SEQ ID NO: 100
  Synthetic Polypeptide

SEQ ID NO: 354 - protein, 459 aa, Artificial Sequence
  Synthetic Polypeptide
QVQLQESGPGLVKPSQTLSLTCTVSGGSISSGGYYWSWIRQHPGKGLEWIGYIYYSGSTSYNPSLKSRVTISVDTSKNQFSLKLSSVTAADTAVYYCARDLDYDISTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 355 - protein, 214 aa, Artificial Sequence; identical to SEQ ID NO: 100
  Synthetic Polypeptide

SEQ ID NO: 356 - protein, 459 aa, Artificial Sequence
  Synthetic Polypeptide
QVQLQESGPGLVKPSQTLSLTCTVSGGSISSGGYYWSWIRQHPGKGLEWIGYIYYSGSTSYNPSLKSRVTISVDTSKNQFSLKLSSVTAADTAVYYCARDLDYDILAGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 357 - protein, 214 aa, Artificial Sequence; identical to SEQ ID NO: 100
  Synthetic Polypeptide

SEQ ID NO: 358 - protein, 459 aa, Artificial Sequence
  Synthetic Polypeptide
QVQLQESGPGLVKPSQTLSLTCTVSGGSISSGGYYWSWIRQHPGKGLEWIGYIYYSGYRFYNPSLKSRVTISVDTSKNQFSLKLSSVTAADTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 359 - protein, 214 aa, Artificial Sequence; identical to SEQ ID NO: 100
  Synthetic Polypeptide

SEQ ID NO: 360 - protein, 459 aa, Artificial Sequence
  Synthetic Polypeptide
QVQLQESGPGLVKPSQTLSLTCTVSGGSISSGGHYWSWIRQHPGKGLEWIGYIYYSGNRHYNPSLKSRVTISVDTSKNQFSLKLSSVTAADTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 361 - protein, 214 aa, Artificial Sequence; identical to SEQ ID NO: 100
  Synthetic Polypeptide

SEQ ID NO: 362 - protein, 459 aa, Artificial Sequence
  Synthetic Polypeptide
QVQLQESGPGLVKPSQTLSLTCTVSGGSISSGGYYWSWIRQHPGKGLEWIGYIYYSGAKAYNPSLKSRVTISVDTSKNQFSLKLSSVTAADTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 363 - protein, 214 aa, Artificial Sequence; identical to SEQ ID NO: 100
  Synthetic Polypeptide

SEQ ID NO: 364 - protein, 459 aa, Artificial Sequence
  Synthetic Polypeptide
QVQLQESGPGLVKPSQTLSLTCTVSGGSISSGGYYWSWIRQHPGKGLEWIGHSHYSGSTSYNPSLKSRVTISVDTSKNQFSLKLSSVTAADTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 365 - protein, 214 aa, Artificial Sequence; identical to SEQ ID NO: 100
  Synthetic Polypeptide

SEQ ID NO: 366 - protein, 459 aa, Artificial Sequence
  Synthetic Polypeptide
QVQLQESGPGLVKPSQTLSLTCTVSGGSISSGGYYWSWIRQHPGKGLEWIGYIYYSGVSYYNPSLKSRVTISVDTSKNQFSLKLSSVTAADTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 367 - protein, 214 aa, Artificial Sequence; identical to SEQ ID NO: 100
  Synthetic Polypeptide

SEQ ID NO: 368 - protein, 459 aa, Artificial Sequence
  Synthetic Polypeptide
QVQLQESGPGLVKPSQTLSLTCTVSGGSISSGGYYWSWIRQHPGKGLEWIGYIYYSGVSNYNPSLKSRVTISVDTSKNQFSLKLSSVTAADTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 369 - protein, 214 aa, Artificial Sequence; identical to SEQ ID NO: 100
  Synthetic Polypeptide

SEQ ID NO: 370 - protein, 459 aa, Artificial Sequence
  Synthetic Polypeptide
QVQLQESGPGLVKPSQTLSLTCTVSGGSISSGGYYWSWIRQHPGKGLEWIGYIYYSGSTSAAPSLKSRVTISVDTSKNQFSLKLSSVTAADTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 371 - protein, 214 aa, Artificial Sequence; identical to SEQ ID NO: 100
  Synthetic Polypeptide

SEQ ID NO: 372 - protein, 459 aa, Artificial Sequence
  Synthetic Polypeptide
QVQLQESGPGLVKPSQTLSLTCTVSGGSISSGGYYWSWIRQHPGKGLEWIGYIYYSGSTSYNPSLKSRVTISVDTSKNQFSLKLSSVTAADTAVYYCARDLDYDILTYLPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 373 - protein, 214 aa, Artificial Sequence; identical to SEQ ID NO: 100
  Synthetic Polypeptide

SEQ ID NO: 374 - protein, 459 aa, Artificial Sequence
  Synthetic Polypeptide
QVQLQESGPGLVKPSQTLSLTCTVSGGSISSGGYYWSWIRQHPGKGLEWIGYIYYSGSTSYNPSLKSRVTISVDTSKNQFSLKLSSVTAADTAVYYCARDLDYDILTGYPRWDYGIDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 375 - protein, 214 aa, Artificial Sequence; identical to SEQ ID NO: 100
  Synthetic Polypeptide

SEQ ID NO: 376 - protein, 459 aa, Artificial Sequence
  Synthetic Polypeptide
QVQLQESGPGLVKPSQTLSLTCTVSGGSISSGGYYWSWIRQHPGKGLEWIGYIYYSGSTSYNPSLKSRVTISVDTSKNQFSLKLSSVTAADTAVYYCARDLDYDILTGYPRWDYGVDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 377 - protein, 214 aa, Artificial Sequence
  Synthetic Polypeptide
EIVMTQSPATLSVSPGERATLSCKSGQSVSNNLAWYQQKPGQAPRLLIYSESTRATGIPDRFSGSGSGTEFTLTISSLQSEDFAVYYCQQHNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 378 - protein, 459 aa, Artificial Sequence; identical to SEQ ID NO: 99
  Synthetic Polypeptide

SEQ ID NO: 379 - protein, 214 aa, Artificial Sequence
  Synthetic Polypeptide
EIVMTQSPATLSVSPGERATLSCQAGQSVSNNLAWYQQKPGQAPRLLIYSESTRATGIPDRFSGSGSGTEFTLTISSLQSEDFAVYYCQQHNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 380 - protein, 459 aa, Artificial Sequence; identical to SEQ ID NO: 99
  Synthetic Polypeptide

SEQ ID NO: 381 - protein, 214 aa, Artificial Sequence
  Synthetic Polypeptide
EIVMTQSPATLSVSPGERATLSCYVSQSVSNNLAWYQQKPGQAPRLLIYSESTRATGIPDRFSGSGSGTEFTLTISSLQSEDFAVYYCQQHNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 382 - protein, 459 aa, Artificial Sequence; identical to SEQ ID NO: 99
  Synthetic Polypeptide

SEQ ID NO: 383 - protein, 214 aa, Artificial Sequence
  Synthetic Polypeptide
EIVMTQSPATLSVSPGERATLSCRASQLISNNLAWYQQKPGQAPRLLIYSESTRATGIPDRFSGSGSGTEFTLTISSLQSEDFAVYYCQQHNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 384 - protein, 459 aa, Artificial Sequence; identical to SEQ ID NO: 99
  Synthetic Polypeptide

SEQ ID NO: 385 - protein, 214 aa, Artificial Sequence
  Synthetic Polypeptide
EIVMTQSPATLSVSPGERATLSCRASQPISNNLAWYQQKPGQAPRLLIYSESTRATGIPDRFSGSGSGTEFTLTISSLQSEDFAVYYCQQHNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 386 - protein, 459 aa, Artificial Sequence; identical to SEQ ID NO: 99
  Synthetic Polypeptide

SEQ ID NO: 387 - protein, 214 aa, Artificial Sequence
  Synthetic Polypeptide
EIVMTQSPATLSVSPGERATLSCRASQSISNNLAWYQQKPGQAPRLLIYSESTRATGIPDRFSGSGSGTEFTLTISSLQSEDFAVYYCQQHNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 388 - protein, 459 aa, Artificial Sequence; identical to SEQ ID NO: 99
  Synthetic Polypeptide

SEQ ID NO: 389 - protein, 214 aa, Artificial Sequence
  Synthetic Polypeptide
EIVMTQSPATLSVSPGERATLSCRASQSVSNNLAWYQQKPGQAPRLLIYSESTNAIGIPDRFSGSGSGTEFTLTISSLQSEDFAVYYCQQHNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 390 - protein, 459 aa, Artificial Sequence; identical to SEQ ID NO: 99
  Synthetic Polypeptide

SEQ ID NO: 391 - protein, 214 aa, Artificial Sequence
  Synthetic Polypeptide
EIVMTQSPATLSVSPGERATLSCRASQSVSNNLAWYQQKPGQAPRLLIYSESTRATGIPDRFSGSGSGTEFTLTISSLQSEDFAVYYCQHYNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 392 - protein, 459 aa, Artificial Sequence; identical to SEQ ID NO: 99
  Synthetic Polypeptide

SEQ ID NO: 393 - protein, 214 aa, Artificial Sequence
  Synthetic Polypeptide
EIVMTQSPATLSVSPGERATLSCRASQSVSNNLAWYQQKPGQAPRLLIYSESTRATGIPDRFSGSGSGTEFTLTISSLQSEDFAVYYCQQYNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 394 - protein, 459 aa, Artificial Sequence; identical to SEQ ID NO: 99
  Synthetic Polypeptide

SEQ ID NO: 395 - protein, 214 aa, Artificial Sequence
  Synthetic Polypeptide
EIVMTQSPATLSVSPGERATLSCRASQSVSNNLAWYQQKPGQAPRLLIYSESTRATGIPDRFSGSGSGTEFTLTISSLQSEDFAVYYCQQHDRFPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 396 - protein, 459 aa, Artificial Sequence; identical to SEQ ID NO: 99
  Synthetic Polypeptide

SEQ ID NO: 397 - protein, 214 aa, Artificial Sequence; identical to SEQ ID NO: 387
  Synthetic Polypeptide

SEQ ID NO: 398 - protein, 459 aa, Artificial Sequence; identical to SEQ ID NO: 364
  Synthetic Polypeptide

SEQ ID NO: 399 - protein, 214 aa, Artificial Sequence; identical to SEQ ID NO: 387
  Synthetic Polypeptide

SEQ ID NO: 400 - protein, 459 aa, Artificial Sequence
  Synthetic Polypeptide
QVQLQESGPGLVKPSQTLSLTCTVSGGSISSGGHYWSWIRQHPGKGLEWIGHSHYSGSTSYNPSLKSRVTISVDTSKNQFSLKLSSVTAADTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 401 - protein, 214 aa, Artificial Sequence; identical to SEQ ID NO: 387
  Synthetic Polypeptide

SEQ ID NO: 402 - protein, 459 aa, Artificial Sequence
  Synthetic Polypeptide
QVQLQESGPGLVKPSQTLSLTCTVSGGSISSGGYYWSWIRQHPGKGLEWIGYIYYSGFRLYNPSLKSRVTISVDTSKNQFSLKLSSVTAADTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 403 - protein, 214 aa, Artificial Sequence; identical to SEQ ID NO: 387
  Synthetic Polypeptide

SEQ ID NO: 404 - protein, 459 aa, Artificial Sequence; identical to SEQ ID NO: 362
  Synthetic Polypeptide

SEQ ID NO: 405 - protein, 214 aa, Artificial Sequence; identical to SEQ ID NO: 387
  Synthetic Polypeptide

SEQ ID NO: 406 - protein, 459 aa, Artificial Sequence
  Synthetic Polypeptide
QVQLQESGPGLVKPSQTLSLTCTVSGGSISSGGHYWSWIRQHPGKGLEWIGHSHYSGAKAYNPSLKSRVTISVDTSKNQFSLKLSSVTAADTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 407 - protein, 214 aa, Artificial Sequence; identical to SEQ ID NO: 387
  Synthetic Polypeptide

SEQ ID NO: 408 - protein, 459 aa, Artificial Sequence
  Synthetic Polypeptide
QVQLQESGPGLVKPSQTLSLTCTVSGGSISSGGYYWSWIRQHPGKGLEWIGYIYYSGFRLYNPSLKSRVTISVDTSKNQFSLKLSSVTAADTAVYYCARDLDYDILTGYPRLDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 409 - protein, 214 aa, Artificial Sequence; identical to SEQ ID NO: 387
  Synthetic Polypeptide

SEQ ID NO: 410 - protein, 459 aa, Artificial Sequence
  Synthetic Polypeptide
QVQLQESGPGLVKPSQTLSLTCTVSGGSISSGGYYWSWIRQHPGKGLEWIGYIYYSGFRLYNPSLKSRVTISVDTSKNQFSLKLSSVTAADTAVYYCARDLDYDILTGYPRFDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 411 - protein, 214 aa, Artificial Sequence; identical to SEQ ID NO: 387
  Synthetic Polypeptide

SEQ ID NO: 412 - protein, 459 aa, Artificial Sequence
  Synthetic Polypeptide
QVQLQESGPGLVKPSQTLSLTCTVSGGSISSGGYYWSWIRQHPGKGLEWIGYIYYSGAKAYNPSLKSRVTISVDTSKNQFSLKLSSVTAADTAVYYCARDLDYDILTGYPRFDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 413 - protein, 214 aa, Artificial Sequence
  Synthetic Polypeptide
DIQMTQSPSSLSASVGDRVTITCRASQGIRNDLGWYQQKPGKAPKRLIYSASSLQSGVPSRFSGSGSGTEFTLTISSLQPEDFATYYCLQSNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 414 - protein, 448 aa, Artificial Sequence
  Synthetic Polypeptide
EVQLVESGGGLVQPGGSLRLSCAASGFTFSRDDMHWVRQATGKGLEWVAGIDNAGDTYYPGSVKGRFTISRENAKNSLYLQMNSLRAGDTAVYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 415 - protein, 214 aa, Artificial Sequence; identical to SEQ ID NO: 413
  Synthetic Polypeptide

SEQ ID NO: 416 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 417 - protein, 214 aa, Artificial Sequence; identical to SEQ ID NO: 413
  Synthetic Polypeptide

SEQ ID NO: 418 - protein, 448 aa, Artificial Sequence
  Synthetic Polypeptide
EVQLVESGGGLVQPGGSLRLSCAASGFTFSRDELHWVRQATGKGLEWVAGIDNAGETYYPGSVKGRFTISRENAKNSLYLQMNSLRAGDTAVYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 419 - protein, 214 aa, Artificial Sequence; identical to SEQ ID NO: 413
  Synthetic Polypeptide

SEQ ID NO: 420 - protein, 448 aa, Artificial Sequence
  Synthetic Polypeptide
EVQLVESGGGLVQPGGSLRLSCAASGFTFSRDDMHWVRQATGKGLEWVAGIANAGETYYPGSVKGRFTISRENAKNSLYLQMNSLRAGDTAVYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 421 - protein, 214 aa, Artificial Sequence; identical to SEQ ID NO: 413
  Synthetic Polypeptide

SEQ ID NO: 422 - protein, 448 aa, Artificial Sequence
  Synthetic Polypeptide
EVQLVESGGGLVQPGGSLRLSCAASGFTFSRDDMHWVRQATGKGLEWVAGIDNAGETEYPGIVKGRFTISRENAKNSLYLQMNSLRAGDTAVYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 423 - protein, 214 aa, Artificial Sequence; identical to SEQ ID NO: 413
  Synthetic Polypeptide

SEQ ID NO: 424 - protein, 448 aa, Artificial Sequence
  Synthetic Polypeptide
EVQLVESGGGLVQPGGSLRLSCAASGFTFSRDDMHWVRQATGKGLEWVAGIDNAGETEYPGQVKGRFTISRENAKNSLYLQMNSLRAGDTAVYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 425 - protein, 214 aa, Artificial Sequence; identical to SEQ ID NO: 413
  Synthetic Polypeptide

SEQ ID NO: 426 - protein, 448 aa, Artificial Sequence
  Synthetic Polypeptide
EVQLVESGGGLVQPGGSLRLSCAASGFTFSRDDMHWVRQATGKGLEWVAGIDNAGETEYPGHVKGRFTISRENAKNSLYLQMNSLRAGDTAVYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 427 - protein, 214 aa, Artificial Sequence; identical to SEQ ID NO: 413
  Synthetic Polypeptide

SEQ ID NO: 428 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVVGHFTISRENAKNSLYLQMNSLRAGDTAVYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 429 - protein, 214 aa, Artificial Sequence; identical to SEQ ID NO: 413
  Synthetic Polypeptide

SEQ ID NO: 430 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGFFPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 431 - protein, 214 aa, Artificial Sequence; identical to SEQ ID NO: 413
  Synthetic Polypeptide

SEQ ID NO: 432 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGYYPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 433 - protein, 214 aa, Artificial Sequence; identical to SEQ ID NO: 413
  Synthetic Polypeptide

SEQ ID NO: 434 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGYFPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 435 - protein, 214 aa, Artificial Sequence; identical to SEQ ID NO: 413
  Synthetic Polypeptide

SEQ ID NO: 436 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGSFPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 437 - protein, 214 aa, Artificial Sequence; identical to SEQ ID NO: 413
  Synthetic Polypeptide

SEQ ID NO: 438 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGQWPYGFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 439 - protein, 214 aa, Artificial Sequence; identical to SEQ ID NO: 413
  Synthetic Polypeptide

SEQ ID NO: 440 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGQWPYGVDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 441 - protein, 214 aa, Artificial Sequence; identical to SEQ ID NO: 413
  Synthetic Polypeptide

SEQ ID NO: 442 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGQWPYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 443 - protein, 214 aa, Artificial Sequence
  Synthetic Polypeptide
DIQMTQSPSSLSASVGDRVTITCRASQGIRNDLGWYQQKPGKAPKRLIYSASSLQSGVPSRFSGSGSGTEFTLTISSLQPEDFATYYCLQSTNYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 444 - protein, 448 aa, Artificial Sequence; identical to SEQ ID NO: 416
  Synthetic Polypeptide

SEQ ID NO: 445 - protein, 214 aa, Artificial Sequence
  Synthetic Polypeptide
DIQMTQSPSSLSASVGDRVTITCRASQGIRNDLGWYQQKPGKAPKRLIYSASSLQSGVPSRFSGSGSGTEFTLTISSLQPEDFATYYCLQSNSEPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 446 - protein, 448 aa, Artificial Sequence; identical to SEQ ID NO: 416
  Synthetic Polypeptide

SEQ ID NO: 447 - protein, 214 aa, Artificial Sequence; identical to SEQ ID NO: 413
  Synthetic Polypeptide

SEQ ID NO: 448 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGQWPYGIDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 449 - protein, 214 aa, Artificial Sequence; identical to SEQ ID NO: 413
  Synthetic Polypeptide

SEQ ID NO: 450 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGQWPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 451 - protein, 214 aa, Artificial Sequence; identical to SEQ ID NO: 413
  Synthetic Polypeptide

SEQ ID NO: 452 - protein, 448 aa, Artificial Sequence
  Synthetic Polypeptide
EVQLVESGGGLVQPGGSLRLSCAASGFTFSRDDMHWVRQATGKGLEWVAGIDNAGETEYPGAVKGRFTISRENAKNSLYLQMNSLRAGDTAVYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 453 - protein, 214 aa, Artificial Sequence; identical to SEQ ID NO: 413
  Synthetic Polypeptide

SEQ ID NO: 454 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGVVKGRFTISRENAKNSLYLQMNSLRAGDTAVYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 455 - protein, 214 aa, Artificial Sequence; identical to SEQ ID NO: 413
  Synthetic Polypeptide

SEQ ID NO: 456 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVPGRFTISRENAKNSLYLQMNSLRAGDTAVYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 457 - protein, 214 aa, Artificial Sequence
  Synthetic Polypeptide
DIQMTQSPSSLSASVGDRVTITCQASQGIRNDLGWYQQKPGKAPKRLIYSASSLQSGVPSRFSGSGSGTEFTLTISSLQPEDFATYYCLQSNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 458 - protein, 448 aa, Artificial Sequence; identical to SEQ ID NO: 456
  Synthetic Polypeptide

SEQ ID NO: 459 - protein, 214 aa, Artificial Sequence; identical to SEQ ID NO: 413
  Synthetic Polypeptide

SEQ ID NO: 460 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVLGRFTISRENAKNSLYLQMNSLRAGDTAVYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 461 - protein, 214 aa, Artificial Sequence; identical to SEQ ID NO: 413
  Synthetic Polypeptide

SEQ ID NO: 462 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVEGRFTISRENAKNSLYLQMNSLRAGDTAVYYCAREGQWPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 463 - protein, 214 aa, Artificial Sequence
  Synthetic Polypeptide
DIQMTQSPSSLSASVGDRVTITCRASQGIKNDLGWYQQKPGKAPKRLIYSASSLQSGVPSRFSGSGSGTEFTLTISSLQPEDFATYYCLQSNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 464 - protein, 448 aa, Artificial Sequence; identical to SEQ ID NO: 416
  Synthetic Polypeptide

SEQ ID NO: 465 - protein, 214 aa, Artificial Sequence
  Synthetic Polypeptide
DIQMTQSPSSLSASVGDRVTITCRASQGIRNDLGWYQQKPGKAPKRLIYSASSLQSGVPSRFSGSGSGTEFTLTISSLQPEDFATYYCLQSTKYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 466 - protein, 448 aa, Artificial Sequence; identical to SEQ ID NO: 416
  Synthetic Polypeptide

SEQ ID NO: 467 - protein, 214 aa, Artificial Sequence; identical to SEQ ID NO: 413
  Synthetic Polypeptide

SEQ ID NO: 468 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGQWPSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 469 - protein, 214 aa, Artificial Sequence; identical to SEQ ID NO: 413
  Synthetic Polypeptide

SEQ ID NO: 470 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGQWPYGFGVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 471 - protein, 214 aa, Artificial Sequence; identical to SEQ ID NO: 413
  Synthetic Polypeptide

SEQ ID NO: 472 - protein, 448 aa, Artificial Sequence
  Synthetic Polypeptide
EVQLVESGGGLVQPGGSLRLSCAASGFTFSRDDMHWVRQATGKGLEWVAGIDNAGETEYPGAVKGRFTISRENAKNSLYLQMNSLRAGDTAVYYCAREGGFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 473 - protein, 214 aa, Artificial Sequence; identical to SEQ ID NO: 413
  Synthetic Polypeptide

SEQ ID NO: 474 - protein, 448 aa, Artificial Sequence
  Synthetic Polypeptide
EVQLVESGGGLVQPGGSLRLSCAASGFTFSRDDMHWVRQATGKGLEWVAGIDNAGETEYPGAVKGRFTISRENAKNSLYLQMNSLRAGDTAVYYCAREGYFPSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 475 - protein, 214 aa, Artificial Sequence; identical to SEQ ID NO: 413
  Synthetic Polypeptide

SEQ ID NO: 476 - protein, 448 aa, Artificial Sequence
  Synthetic Polypeptide
EVQLVESGGGLVQPGGSLRLSCAASGFTFSRDDMHWVRQATGKGLEWVAGIDNAGETEYPGAVKGRFTISRENAKNSLYLQMNSLRAGDTAVYYCAREGSFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 477 - protein, 214 aa, Artificial Sequence; identical to SEQ ID NO: 413
  Synthetic Polypeptide

SEQ ID NO: 478 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVLGRFTISRENAKNSLYLQMNSLRAGDTAVYYCAREGFFPSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 479 - protein, 214 aa, Artificial Sequence; identical to SEQ ID NO: 413
  Synthetic Polypeptide

SEQ ID NO: 480 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVLGRFTISRENAKNSLYLQMNSLRAGDTAVYYCAREGGFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 481 - protein, 214 aa, Artificial Sequence; identical to SEQ ID NO: 413
  Synthetic Polypeptide

SEQ ID NO: 482 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVLGRFTISRENAKNSLYLQMNSLRAGDTAVYYCAREGYFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 483 - protein, 214 aa, Artificial Sequence; identical to SEQ ID NO: 413
  Synthetic Polypeptide

SEQ ID NO: 484 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVLGRFTISRENAKNSLYLQMNSLRAGDTAVYYCAREGSFPSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 485 - protein, 214 aa, Artificial Sequence; identical to SEQ ID NO: 413
  Synthetic Polypeptide

SEQ ID NO: 486 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVPGRFTISRENAKNSLYLQMNSLRAGDTAVYYCAREGSFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 487 - protein, 214 aa, Artificial Sequence; identical to SEQ ID NO: 413
  Synthetic Polypeptide

SEQ ID NO: 488 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVPGRFTISRENAKNSLYLQMNSLRAGDTAVYYCAREGFFPSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 489 - protein, 214 aa, Artificial Sequence; identical to SEQ ID NO: 445
  Synthetic Polypeptide

SEQ ID NO: 490 - protein, 448 aa, Artificial Sequence; identical to SEQ ID NO: 476
  Synthetic Polypeptide

SEQ ID NO: 491 - protein, 214 aa, Artificial Sequence; identical to SEQ ID NO: 445
  Synthetic Polypeptide

SEQ ID NO: 492 - protein, 448 aa, Artificial Sequence
  Synthetic Polypeptide
EVQLVESGGGLVQPGGSLRLSCAASGFTFSRDDMHWVRQATGKGLEWVAGIDNAGETEYPGAVKGRFTISRENAKNSLYLQMNSLRAGDTAVYYCAREGFFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 493 - protein, 214 aa, Artificial Sequence; identical to SEQ ID NO: 445
  Synthetic Polypeptide

SEQ ID NO: 494 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGSFPSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 495 - protein, 214 aa, Artificial Sequence; identical to SEQ ID NO: 445
  Synthetic Polypeptide

SEQ ID NO: 496 - protein, 448 aa, Artificial Sequence
  Synthetic Polypeptide
EVQLVESGGGLVQPGGSLRLSCAASGFTFSRDDMHWVRQATGKGLEWVAGIDNAGETYYPGSVKGRFTISRENAKNSLYLQMNSLRAGDTAVYYCAREGFFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 497 - protein, 214 aa, Artificial Sequence; identical to SEQ ID NO: 413
  Synthetic Polypeptide

SEQ ID NO: 498 - protein, 448 aa, Artificial Sequence
  Synthetic Polypeptide
EVQLVESGGGLVQPGGSLRLSCAASGFTFSRDDMHWVRQATGKGLEWVAGIDNAGETEYPGAVLGRFTISRENAKNSLYLQMNSLRAGDTAVYYCAREGQWPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 499 - protein, 214 aa, Artificial Sequence; identical to SEQ ID NO: 413
  Synthetic Polypeptide

SEQ ID NO: 500 - protein, 448 aa, Artificial Sequence
  Synthetic Polypeptide
EVQLVESGGGLVQPGGSLRLSCAASGFTFSRDDMHWVRQATGKGLEWVAGIDNAGETEYPGAVPGRFTISRENAKNSLYLQMNSLRAGDTAVYYCAREGQWPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 501 - protein, 214 aa, Artificial Sequence; identical to SEQ ID NO: 413
  Synthetic Polypeptide

SEQ ID NO: 502 - protein, 448 aa, Artificial Sequence
  Synthetic Polypeptide
EVQLVESGGGLVQPGGSLRLSCAASGFTFSRDDMHWVRQATGKGLEWVAGIDNAGETEYPGAVLGRFTISRENAKNSLYLQMNSLRAGDTAVYYCAREGQWPSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 503 - protein, 214 aa, Artificial Sequence; identical to SEQ ID NO: 413
  Synthetic Polypeptide

SEQ ID NO: 504 - protein, 448 aa, Artificial Sequence
  Synthetic Polypeptide
EVQLVESGGGLVQPGGSLRLSCAASGFTFSRDDMHWVRQATGKGLEWVAGIDNAGETEYPGAVPGRFTISRENAKNSLYLQMNSLRAGDTAVYYCAREGFFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 505 - protein, 214 aa, Artificial Sequence; identical to SEQ ID NO: 413
  Synthetic Polypeptide

SEQ ID NO: 506 - protein, 448 aa, Artificial Sequence
  Synthetic Polypeptide
EVQLVESGGGLVQPGGSLRLSCAASGFTFSRDDMHWVRQATGKGLEWVAGIDNAGDTEYPGAVLGRFTISRENAKNSLYLQMNSLRAGDTAVYYCAREGFFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 507 - protein, 214 aa, Artificial Sequence; identical to SEQ ID NO: 413
  Synthetic Polypeptide

SEQ ID NO: 508 - protein, 448 aa, Artificial Sequence
  Synthetic Polypeptide
EVQLVESGGGLVQPGGSLRLSCAASGFTFSRDDMHWVRQATGKGLEWVAGIDNAGDTEYPGAVPGRFTISRENAKNSLYLQMNSLRAGDTAVYYCAREGFFPSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 509 - protein, 214 aa, Artificial Sequence; identical to SEQ ID NO: 40
  Synthetic Polypeptide

SEQ ID NO: 510 - protein, 447 aa, Artificial Sequence; identical to SEQ ID NO: 59
  Synthetic Polypeptide

SEQ ID NO: 511 - protein, 214 aa, Artificial Sequence; identical to SEQ ID NO: 40
  Synthetic Polypeptide

SEQ ID NO: 512 - protein, 447 aa, Artificial Sequence
  Synthetic Polypeptide
EVQLVESGGGLVQPGGSLRLSCAASGFTFANYDMHWVRQAPGKGLEWVSDIGNSGETYYLGSVKGRFTISRENAKNSLYLQMNSLRAGDTAVYYCVREEFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 513 - protein, 214 aa, Artificial Sequence; identical to SEQ ID NO: 40
  Synthetic Polypeptide

SEQ ID NO: 514 - protein, 447 aa, Artificial Sequence
  Synthetic Polypeptide
EVQLVESGGGLVQPGGSLRLSCAASGFTFDNYDMHWVRQAPGKGLEWVSDIGNSGETYYLGSVKGRFTISRENAKNSLYLQMNSLRAGDTAVYYCVREEFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 515 - protein, 214 aa, Artificial Sequence; identical to SEQ ID NO: 40
  Synthetic Polypeptide

SEQ ID NO: 516 - protein, 447 aa, Artificial Sequence
  Synthetic Polypeptide
EVQLVESGGGLVQPGGSLRLSCAASGFTFSNYDMHWVRQAPGKGLEWVSDIGNSGETYYLGSVKGRFTISRENAKNSLYLQMNSLRAGDTAVYYCVREEFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 517 - protein, 214 aa, Artificial Sequence; identical to SEQ ID NO: 40
  Synthetic Polypeptide

SEQ ID NO: 518 - protein, 447 aa, Artificial Sequence
  Synthetic Polypeptide
EVQLVESGGGLVQPGGSLRLSCAASGFTFRNFDMHWVRQAPGKGLEWVSDIGNSGETYYLGSVKGRFTISRENAKNSLYLQMNSLRAGDTAVYYCVREEFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 519 - protein, 214 aa, Artificial Sequence; identical to SEQ ID NO: 40
  Synthetic Polypeptide

SEQ ID NO: 520 - protein, 447 aa, Artificial Sequence
  Synthetic Polypeptide
EVQLVESGGGLVQPGGSLRLSCAASGFTFRNYDMHWVRQAPGKGLEWVSDIGNSGEVQYLGSVKGRFTISRENAKNSLYLQMNSLRAGDTAVYYCVREEFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 521 - protein, 214 aa, Artificial Sequence; identical to SEQ ID NO: 40
  Synthetic Polypeptide

SEQ ID NO: 522 - protein, 447 aa, Artificial Sequence
  Synthetic Polypeptide
EVQLVESGGGLVQPGGSLRLSCAASGFTFRNYDMHWVRQAPGKGLEWVSDIGNSGEQYYLGSVKGRFTISRENAKNSLYLQMNSLRAGDTAVYYCVREEFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 523 - protein, 214 aa, Artificial Sequence; identical to SEQ ID NO: 40
  Synthetic Polypeptide

SEQ ID NO: 524 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVAGQFTISRENAKNSLYLQMNSLRAGDTAVYYCVREEFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 525 - protein, 214 aa, Artificial Sequence; identical to SEQ ID NO: 40
  Synthetic Polypeptide

SEQ ID NO: 526 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVEGRFTISRENAKNSLYLQMNSLRAGDTAVYYCVREEFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 527 - protein, 214 aa, Artificial Sequence; identical to SEQ ID NO: 40
  Synthetic Polypeptide

SEQ ID NO: 528 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVQGVFTISRENAKNSLYLQMNSLRAGDTAVYYCVREEFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 529 - protein, 214 aa, Artificial Sequence; identical to SEQ ID NO: 40
  Synthetic Polypeptide

SEQ ID NO: 530 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREPFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 531 - protein, 214 aa, Artificial Sequence; identical to SEQ ID NO: 40
  Synthetic Polypeptide

SEQ ID NO: 532 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREHFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 533 - protein, 214 aa, Artificial Sequence; identical to SEQ ID NO: 40
  Synthetic Polypeptide

SEQ ID NO: 534 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVRELFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 535 - protein, 214 aa, Artificial Sequence; identical to SEQ ID NO: 40
  Synthetic Polypeptide

SEQ ID NO: 536 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREEFAHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 537 - protein, 214 aa, Artificial Sequence; identical to SEQ ID NO: 40
  Synthetic Polypeptide

SEQ ID NO: 538 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREEFGHGVDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 539 - protein, 214 aa, Artificial Sequence; identical to SEQ ID NO: 40
  Synthetic Polypeptide

SEQ ID NO: 540 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREEFGVGVDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 541 - protein, 214 aa, Artificial Sequence
  Synthetic Polypeptide
DIQMTQSPSSLSASVGDRVTITCYASQGIRNDLGWYQQKPGKAPKRLIYAASSLQSGVPSRFSGSGSGTEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 542 - protein, 447 aa, Artificial Sequence; identical to SEQ ID NO: 59
  Synthetic Polypeptide

SEQ ID NO: 543 - protein, 214 aa, Artificial Sequence
  Synthetic Polypeptide
DIQMTQSPSSLSASVGDRVTITCFASQGIRNDLGWYQQKPGKAPKRLIYAASSLQSGVPSRFSGSGSGTEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 544 - protein, 447 aa, Artificial Sequence; identical to SEQ ID NO: 59
  Synthetic Polypeptide

SEQ ID NO: 545 - protein, 214 aa, Artificial Sequence
  Synthetic Polypeptide
DIQMTQSPSSLSASVGDRVTITCLASQGIRNDLGWYQQKPGKAPKRLIYAASSLQSGVPSRFSGSGSGTEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 546 - protein, 447 aa, Artificial Sequence; identical to SEQ ID NO: 59
  Synthetic Polypeptide

SEQ ID NO: 547 - protein, 214 aa, Artificial Sequence; identical to SEQ ID NO: 40
  Synthetic Polypeptide

SEQ ID NO: 548 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREEFPQGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 549 - protein, 214 aa, Artificial Sequence; identical to SEQ ID NO: 40
  Synthetic Polypeptide

SEQ ID NO: 550 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREEFPVGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 551 - protein, 214 aa, Artificial Sequence
  Synthetic Polypeptide
DIQMTQSPSSLSASVGDRVTITCRASQGIRNDLGWYQQKPGKAPKRLIHAASSLQSGVPSRFSGSGSGTEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 552 - protein, 447 aa, Artificial Sequence
  Synthetic Polypeptide
EVQLVESGGGLVQPGGSLRLSCAASGFTFRNYDMHWVRQAPGKGLEWVSDIGNSGETYYLGSVKGRFTISRENAKNSLYLQMNSLRAGDTAVYYCVREEFANGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 553 - protein, 214 aa, Artificial Sequence
  Synthetic Polypeptide
DIQMTQSPSSLSASVGDRVTITCRASQGIRGDLGWYQQKPGKAPKRLIYAASSLQSGVPSRFSGSGSGTEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 554 - protein, 447 aa, Artificial Sequence; identical to SEQ ID NO: 59
  Synthetic Polypeptide

SEQ ID NO: 555 - protein, 214 aa, Artificial Sequence; identical to SEQ ID NO: 40
  Synthetic Polypeptide

SEQ ID NO: 556 - protein, 447 aa, Artificial Sequence
  Synthetic Polypeptide
EVQLVESGGGLVQPGGSLRLSCAASGFTFRNYDMHWVRQAPGKGLEWVSDIGNSGEVQYLGSVKGRFTISRENAKNSLYLQMNSLRAGDTAVYYCVREQFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 557 - protein, 214 aa, Artificial Sequence; identical to SEQ ID NO: 40
  Synthetic Polypeptide

SEQ ID NO: 558 - protein, 447 aa, Artificial Sequence
  Synthetic Polypeptide
EVQLVESGGGLVQPGGSLRLSCAASGFTFRNYDMHWVRQAPGKGLEWVSDIGNSGEVQYLGSVKGRFTISRENAKNSLYLQMNSLRAGDTAVYYCVREQFPVGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 559 - protein, 214 aa, Artificial Sequence; identical to SEQ ID NO: 551
  Synthetic Polypeptide

SEQ ID NO: 560 - protein, 447 aa, Artificial Sequence
  Synthetic Polypeptide
EVQLVESGGGLVQPGGSLRLSCAASGFTFRNYDMHWVRQAPGKGLEWVSDIGNSGEVQYLGSVKGRFTISRENAKNSLYLQMNSLRAGDTAVYYCVREQFANGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 561 - protein, 214 aa, Artificial Sequence; identical to SEQ ID NO: 70
  Synthetic Polypeptide

SEQ ID NO: 562 - protein, 447 aa, Artificial Sequence
  Synthetic Polypeptide
EVQLVESGGGLVQPGGSLRLSCAASGFTFRNYDMHWVRQAPGKGLEWVSDIGNSGEVQYLGSVKGRFTISRENAKNSLYLQMNSLRAGDTAVYYCVREQFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 563 - protein, 214 aa, Artificial Sequence; identical to SEQ ID NO: 40
  Synthetic Polypeptide

SEQ ID NO: 564 - protein, 447 aa, Artificial Sequence
  Synthetic Polypeptide
EVQLVESGGGLVQPGGSLRLSCAASGFTFRNYDMHWVRQAPGKGLEWVSDIGNSGEVQYLGSVKGRFTISRENAKNSLYLQMNSLRAGDTAVYYCVREQFAHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 565 - protein, 214 aa, Artificial Sequence; identical to SEQ ID NO: 40
  Synthetic Polypeptide

SEQ ID NO: 566 - protein, 447 aa, Artificial Sequence
  Synthetic Polypeptide
EVQLVESGGGLVQPGGSLRLSCAASGFTFRNYDMHWVRQAPGKGLEWVSDIGNSGEVQYLGSVKGRFTISRENAKNSLYLQMNSLRAGDTAVYYCVREQFGHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 567 - protein, 214 aa, Artificial Sequence; identical to SEQ ID NO: 40
  Synthetic Polypeptide

SEQ ID NO: 568 - protein, 447 aa, Artificial Sequence
  Synthetic Polypeptide
EVQLVESGGGLVQPGGSLRLSCAASGFTFRNYDMHWVRQAPGKGLEWVSDIGNSGEVQYLGSVKGRFTISRENAKNSLYLQMNSLRAGDTAVYYCVREQFGVGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 569 - protein, 214 aa, Artificial Sequence; identical to SEQ ID NO: 40
  Synthetic Polypeptide

SEQ ID NO: 570 - protein, 447 aa, Artificial Sequence
  Synthetic Polypeptide
EVQLVESGGGLVQPGGSLRLSCAASGFTFRNYDMHWVRQAPGKGLEWVSDIGNSGEVQYLGSVKGRFTISRENAKNSLYLQMNSLRAGDTAVYYCVRELFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 571 - protein, 214 aa, Artificial Sequence; identical to SEQ ID NO: 40
  Synthetic Polypeptide

SEQ ID NO: 572 - protein, 447 aa, Artificial Sequence
  Synthetic Polypeptide
EVQLVESGGGLVQPGGSLRLSCAASGFTFRNYDMHWVRQAPGKGLEWVSDIGNSGEVQYLGSVKGRFTISRENAKNSLYLQMNSLRAGDTAVYYCVRELFPVGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 573 - protein, 214 aa, Artificial Sequence; identical to SEQ ID NO: 70
  Synthetic Polypeptide

SEQ ID NO: 574 - protein, 447 aa, Artificial Sequence
  Synthetic Polypeptide
EVQLVESGGGLVQPGGSLRLSCAASGFTFRNYDMHWVRQAPGKGLEWVSDIGNSGEVQYLGSVKGRFTISRENAKNSLYLQMNSLRAGDTAVYYCVRELFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 575 - protein, 214 aa, Artificial Sequence; identical to SEQ ID NO: 40
  Synthetic Polypeptide

SEQ ID NO: 576 - protein, 447 aa, Artificial Sequence
  Synthetic Polypeptide
EVQLVESGGGLVQPGGSLRLSCAASGFTFRNYDMHWVRQAPGKGLEWVSDIGNSGEVQYLGSVKGRFTISRENAKNSLYLQMNSLRAGDTAVYYCVRELFAHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 577 - protein, 214 aa, Artificial Sequence; identical to SEQ ID NO: 40
  Synthetic Polypeptide

SEQ ID NO: 578 - protein, 447 aa, Artificial Sequence
  Synthetic Polypeptide
EVQLVESGGGLVQPGGSLRLSCAASGFTFRNYDMHWVRQAPGKGLEWVSDIGNSGEVQYLGSVKGRFTISRENAKNSLYLQMNSLRAGDTAVYYCVRELFGHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 579 - protein, 214 aa, Artificial Sequence; identical to SEQ ID NO: 40
  Synthetic Polypeptide

SEQ ID NO: 580 - protein, 447 aa, Artificial Sequence
  Synthetic Polypeptide
EVQLVESGGGLVQPGGSLRLSCAASGFTFRNFDMHWVRQAPGKGLEWVSDIGNSGEVQYLGSVKGRFTISRENAKNSLYLQMNSLRAGDTAVYYCVREEFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 581 - protein, 214 aa, Artificial Sequence; identical to SEQ ID NO: 40
  Synthetic Polypeptide

SEQ ID NO: 582 - protein, 447 aa, Artificial Sequence
  Synthetic Polypeptide
EVQLVESGGGLVQPGGSLRLSCAASGFTFRNFDMHWVRQAPGKGLEWVSDIGNSGEVQYLGSVKGRFTISRENAKNSLYLQMNSLRAGDTAVYYCVREEFPVGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 583 - protein, 214 aa, Artificial Sequence; identical to SEQ ID NO: 551
  Synthetic Polypeptide

SEQ ID NO: 584 - protein, 447 aa, Artificial Sequence
  Synthetic Polypeptide
EVQLVESGGGLVQPGGSLRLSCAASGFTFRNFDMHWVRQAPGKGLEWVSDIGNSGEVQYLGSVKGRFTISRENAKNSLYLQMNSLRAGDTAVYYCVREEFANGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 585 - protein, 214 aa, Artificial Sequence; identical to SEQ ID NO: 70
  Synthetic Polypeptide

SEQ ID NO: 586 - protein, 447 aa, Artificial Sequence
  Synthetic Polypeptide
EVQLVESGGGLVQPGGSLRLSCAASGFTFRNFDMHWVRQAPGKGLEWVSDIGNSGEVQYLGSVKGRFTISRENAKNSLYLQMNSLRAGDTAVYYCVREEFGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 587 - protein, 214 aa, Artificial Sequence; identical to SEQ ID NO: 40
  Synthetic Polypeptide

SEQ ID NO: 588 - protein, 447 aa, Artificial Sequence
  Synthetic Polypeptide
EVQLVESGGGLVQPGGSLRLSCAASGFTFRNFDMHWVRQAPGKGLEWVSDIGNSGEVQYLGSVKGRFTISRENAKNSLYLQMNSLRAGDTAVYYCVREEFAHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 589 - protein, 214 aa, Artificial Sequence; identical to SEQ ID NO: 40
  Synthetic Polypeptide

SEQ ID NO: 590 - protein, 447 aa, Artificial Sequence
  Synthetic Polypeptide
EVQLVESGGGLVQPGGSLRLSCAASGFTFRNFDMHWVRQAPGKGLEWVSDIGNSGEVQYLGSVKGRFTISRENAKNSLYLQMNSLRAGDTAVYYCVREEFGHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 591 - protein, 214 aa, Artificial Sequence; identical to SEQ ID NO: 40
  Synthetic Polypeptide

SEQ ID NO: 592 - protein, 447 aa, Artificial Sequence
  Synthetic Polypeptide
EVQLVESGGGLVQPGGSLRLSCAASGFTFRNFDMHWVRQAPGKGLEWVSDIGNSGEVQYLGSVKGRFTISRENAKNSLYLQMNSLRAGDTAVYYCVREEFGVGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 593 - protein, 214 aa, Artificial Sequence
  Synthetic Polypeptide
DIQMTQSPSSLSASVGDRVTITCRASQGIRGDLGWYQQKPGKAPKRLIYAASSLQSGVPSRFSGSGSGTEFTLTISSLQPEDFATYYCLQHLDYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 594 - protein, 447 aa, Artificial Sequence
  Synthetic Polypeptide
EVQLVESGGGLVQPGGSLRLSCAASGFTFRNFDMHWVRQAPGKGLEWVSDIGNSGEVQYLGSVKGRFTISRENAKNSLYLQMNSLRAGDTAVYYCVREQFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 595 - protein, 214 aa, Artificial Sequence; identical to SEQ ID NO: 40
  Synthetic Polypeptide

SEQ ID NO: 596 - protein, 447 aa, Artificial Sequence
  Synthetic Polypeptide
EVQLVESGGGLVQPGGSLRLSCAASGFTFANYDMHWVRQAPGKGLEWVSDIGNSGETYYLGSVKGRFTISRENAKNSLYLQMNSLRAGDTAVYYCVREQFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 597 - protein, 214 aa, Artificial Sequence; identical to SEQ ID NO: 40
  Synthetic Polypeptide

SEQ ID NO: 598 - protein, 447 aa, Artificial Sequence
  Synthetic Polypeptide
EVQLVESGGGLVQPGGSLRLSCAASGFTFDNYDMHWVRQAPGKGLEWVSDIGNSGETYYLGSVKGRFTISRENAKNSLYLQMNSLRAGDTAVYYCVREQFPQGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 599 - protein, 214 aa, Artificial Sequence; identical to SEQ ID NO: 40
  Synthetic Polypeptide

SEQ ID NO: 600 - protein, 447 aa, Artificial Sequence
  Synthetic Polypeptide
EVQLVESGGGLVQPGGSLRLSCAASGFTFSNYDMHWVRQAPGKGLEWVSDIGNSGETYYLGSVKGRFTISRENAKNSLYLQMNSLRAGDTAVYYCVREQFPVGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 601 - protein, 214 aa, Artificial Sequence; identical to SEQ ID NO: 40
  Synthetic Polypeptide

SEQ ID NO: 602 - protein, 447 aa, Artificial Sequence
  Synthetic Polypeptide
EVQLVESGGGLVQPGGSLRLSCAASGFTFANYDMHWVRQAPGKGLEWVSDIGNSGETYYLGSVKGRFTISRENAKNSLYLQMNSLRAGDTAVYYCVREQFPQGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 603 - protein, 214 aa, Artificial Sequence; identical to SEQ ID NO: 40
  Synthetic Polypeptide

SEQ ID NO: 604 - protein, 447 aa, Artificial Sequence
  Synthetic Polypeptide
EVQLVESGGGLVQPGGSLRLSCAASGFTFDNYDMHWVRQAPGKGLEWVSDIGNSGETYYLGSVKGRFTISRENAKNSLYLQMNSLRAGDTAVYYCVREQFPVGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 605 - protein, 214 aa, Artificial Sequence; identical to SEQ ID NO: 40
  Synthetic Polypeptide

SEQ ID NO: 606 - protein, 447 aa, Artificial Sequence
  Synthetic Polypeptide
EVQLVESGGGLVQPGGSLRLSCAASGFTFSNYDMHWVRQAPGKGLEWVSDIGNSGETYYLGSVKGRFTISRENAKNSLYLQMNSLRAGDTAVYYCVREQFPHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 607 - protein, 214 aa, Artificial Sequence; identical to SEQ ID NO: 551
  Synthetic Polypeptide

SEQ ID NO: 608 - protein, 447 aa, Artificial Sequence
  Synthetic Polypeptide
EVQLVESGGGLVQPGGSLRLSCAASGFTFANYDMHWVRQAPGKGLEWVSDIGNSGETYYLGSVKGRFTISRENAKNSLYLQMNSLRAGDTAVYYCVREQFANGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 609 - protein, 214 aa, Artificial Sequence; identical to SEQ ID NO: 551
  Synthetic Polypeptide

SEQ ID NO: 610 - protein, 447 aa, Artificial Sequence
  Synthetic Polypeptide
EVQLVESGGGLVQPGGSLRLSCAASGFTFDNYDMHWVRQAPGKGLEWVSDIGNSGETYYLGSVKGRFTISRENAKNSLYLQMNSLRAGDTAVYYCVREQFANGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 611 - protein, 214 aa, Artificial Sequence; identical to SEQ ID NO: 551
  Synthetic Polypeptide

SEQ ID NO: 612 - protein, 447 aa, Artificial Sequence
  Synthetic Polypeptide
EVQLVESGGGLVQPGGSLRLSCAASGFTFSNYDMHWVRQAPGKGLEWVSDIGNSGETYYLGSVKGRFTISRENAKNSLYLQMNSLRAGDTAVYYCVREQFANGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 613 - protein, 214 aa, Artificial Sequence; identical to SEQ ID NO: 551
  Synthetic Polypeptide

SEQ ID NO: 614 - protein, 447 aa, Artificial Sequence
  Synthetic Polypeptide
EVQLVESGGGLVQPGGSLRLSCAASGFTFSNYDMHWVRQAPGKGLEWVSDIGNSGETYYLGSVKGRFTISRENAKNSLYLQMNSLRAGDTAVYYCVREQFGHGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 615 - protein, 214 aa, Artificial Sequence
  Synthetic Polypeptide
EIVMTQSPATLSVSPGERATLSCRASQSISRNLAWYQQKPGQAPRLLIYGASIRATVIPARFSGSGSGTEFTLTISSLQSEDFAVYYCQQYNNFHASFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 616 - protein, 452 aa, Artificial Sequence; identical to SEQ ID NO: 263
  Synthetic Polypeptide

SEQ ID NO: 617 - protein, 214 aa, Artificial Sequence
  Synthetic Polypeptide
EIVMTQSPATLSVSPGERATLSCRASQSISRNLAWYQQKPGQAPRLLIYGASIRATVIPARFSGSGSGTEFTLTISSLQSEDFAVYYCQQYNNFHTSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 618 - protein, 452 aa, Artificial Sequence; identical to SEQ ID NO: 263
  Synthetic Polypeptide

SEQ ID NO: 619 - protein, 214 aa, Artificial Sequence
  Synthetic Polypeptide
EIVMTQSPATLSVSPGERATLSCRASQSVSNNLAWYQQKPGQAPRLLIYSESTRATGIPARFSGSGSGTEFTLTISSLQSEDFAVYYCQQHNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 620 - protein, 459 aa, Artificial Sequence
  Synthetic Polypeptide
QVQLVESGGGLVKPGGSLRLSCAVSGGSISSGGYYWSWIRQAPGKGLEWVSYIYYSGSTSYNPSVKGRFTISVDTSKNSFYLQMNSLRAEDTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 621 - protein, 214 aa, Artificial Sequence; identical to SEQ ID NO: 619
  Synthetic Polypeptide

SEQ ID NO: 622 - protein, 459 aa, Artificial Sequence
  Synthetic Polypeptide
EVQLVQSGAEVKKPGESLKISCKVSGGSISSGGYYWSWIRQMPGKGLEWMGYIYYSGSTSYNPSFQGQVTISVDTSKNTFYLQWSSLKASDTAMYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 623 - protein, 214 aa, Artificial Sequence; identical to SEQ ID NO: 619
  Synthetic Polypeptide

SEQ ID NO: 624 - protein, 459 aa, Artificial Sequence
  Synthetic Polypeptide
QVQLVQSGAEVKKPGSSVKVSCKASGGTFSSGGYYWSWVRQAPGQGLEWMGYIYYSGSTSYNPSLKSRVTITADESTSTAYMELSSLRSEDTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 625 - protein, 214 aa, Artificial Sequence; identical to SEQ ID NO: 619
  Synthetic Polypeptide

SEQ ID NO: 626 - protein, 459 aa, Artificial Sequence
  Synthetic Polypeptide
QVQLVQSGAEVKKPGASVKVSCKVSGGSISSGGYYWSWIRQAPGQGLEWMGYIYYSGSTSYNPKFQGRVTITVDTSKNTFYMELSSLRSEDTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 627 - protein, 214 aa, Artificial Sequence
  Synthetic Polypeptide
DIQMTQSPSTLSASVGDRVTITCRASQSVSNNLAWYQQKPGKAPKLLIYSESTRATGVPSRFSGSGSGTEFTLTISSLQPDDFATYYCQQHNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 628 - protein, 459 aa, Artificial Sequence; identical to SEQ ID NO: 620
  Synthetic Polypeptide

SEQ ID NO: 629 - protein, 214 aa, Artificial Sequence; identical to SEQ ID NO: 627
  Synthetic Polypeptide

SEQ ID NO: 630 - protein, 459 aa, Artificial Sequence; identical to SEQ ID NO: 622
  Synthetic Polypeptide

SEQ ID NO: 631 - protein, 214 aa, Artificial Sequence; identical to SEQ ID NO: 627
  Synthetic Polypeptide

SEQ ID NO: 632 - protein, 459 aa, Artificial Sequence; identical to SEQ ID NO: 624
  Synthetic Polypeptide

SEQ ID NO: 633 - protein, 214 aa, Artificial Sequence; identical to SEQ ID NO: 627
  Synthetic Polypeptide

SEQ ID NO: 634 - protein, 459 aa, Artificial Sequence
  Synthetic Polypeptide
QVQLVQSGAEVKKPGSSVKVSCKASGGTFSSGGYYWSWVRQAPGQGLEWMGYIYYSGSTSYNPSLKSRVTITADKSTSTAYMELSSLRSEDTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 635 - protein, 214 aa, Artificial Sequence; identical to SEQ ID NO: 627
  Synthetic Polypeptide

SEQ ID NO: 636 - protein, 459 aa, Artificial Sequence
  Synthetic Polypeptide
QVQLVQSGAEVKKPGSSVKVSCKVSGGSISSGGYYWSWIRQAPGQGLEWMGYIYYSGSTSYNPKFQGRVTITVDTSKNTFYMELSSLRSEDTAVYYCARDLDYDILTGYPRWDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 637 - protein, 214 aa, Artificial Sequence
  Synthetic Polypeptide
DIQMTQSPSSLSASVGDRVTITCRSSQSISSYLNWYQQKPGKAPKLLIYAASSLQSGVPSRFSGSGSGTDFTLTISSLQPEDFATYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 638 - protein, 450 aa, Artificial Sequence
  Synthetic Polypeptide
QVQLQESGPGLVKPSQTLSLTCTVSGGSISSGGYYWSWIRQHPGKGLEWIGYIYYRGGTYYNPSLRSRVTISVDTSKNQFSLKLSSVTAADTAVYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 639 - protein, 214 aa, Artificial Sequence
  Synthetic Polypeptide
DIQMTQSPSSLSASVGDRVTITCRSSQSISSYLNWYQQKPGKAPKLLIHAASSLQSGVPSRFSGSGSGTDFTLTISSLQPEDFATYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 640 - protein, 450 aa, Artificial Sequence
  Synthetic Polypeptide
QVQLQESGPGLVKPSQTLSLTCTVSGGSISSGGYYWSWIRQHPGKGLEWIGYIYYRGGTYYNPSLKSRVTMSVDTSKNQFSLKLSSVTAADTAVYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 641 - protein, 214 aa, Artificial Sequence; identical to SEQ ID NO: 639
  Synthetic Polypeptide

SEQ ID NO: 642 - protein, 450 aa, Artificial Sequence
  Synthetic Polypeptide
EVQLVQSGAEVKKPGESLKISCKVSGGSISSGGYYWSWIRQMPGKGLEWMGYIYYRGGTYYNPSFQGQVTMSVDTSKNTFYLQWSSLKASDTAMYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 643 - protein, 214 aa, Artificial Sequence
  Synthetic Polypeptide
EIVMTQSPGTLSLSPGERATLSCRSSQSISSYLNWYQQKPGQAPRLLIHAASSLQSGIPDRFSGSGSGTDFTLTISRLEPEDFAVYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 644 - protein, 450 aa, Artificial Sequence
  Synthetic Polypeptide
EVQLLESGGGLVQPGGSLRLSCAVSGGSISSGGYYWSWIRQAPGKGLEWVSYIYYRGGTYYNPSVKGRFTMSVDTSKNTFYLQMNSLRAEDTAVYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 645 - protein, 216 aa, Artificial Sequence
  Synthetic Polypeptide
QAGLTQPPSVSKGLRQTATLTCTGNANNVGNRGAAWLQQHQGHPPKLLSYRNNNRPSGISERLSASRSGNTASLTITGLQPEDEADYYCSAWDSSLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 646 - protein, 452 aa, Artificial Sequence
  Synthetic Polypeptide
QVQLVESGGGVVQPGRSLRLSCAASGFTFSSYGMHWVRQAPGKGLEWVALIWFDESNIYYADAVKGRFTISRDNSKNTLYLQMNSLRAEDTAVYYCARGYDLLTGYYNFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 647 - protein, 216 aa, Artificial Sequence; identical to SEQ ID NO: 645
  Synthetic Polypeptide

SEQ ID NO: 648 - protein, 452 aa, Artificial Sequence
  Synthetic Polypeptide
QVQLVESGGGVVQPGRSLRLSCAASGFTFSSYGMHWVRQAPGKGLEWVALIWFDESNIYYADSVKGRFTISRDNAKNTLYLQMNSLRAEDTAVYFCARGYDLLTGYYNFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 649 - protein, 216 aa, Artificial Sequence; identical to SEQ ID NO: 110
  Synthetic Polypeptide

SEQ ID NO: 650 - protein, 452 aa, Artificial Sequence; identical to SEQ ID NO: 648
  Synthetic Polypeptide

SEQ ID NO: 651 - protein, 216 aa, Artificial Sequence; identical to SEQ ID NO: 645
  Synthetic Polypeptide

SEQ ID NO: 652 - protein, 452 aa, Artificial Sequence; identical to SEQ ID NO: 109
  Synthetic Polypeptide

SEQ ID NO: 653 - protein, 216 aa, Artificial Sequence; identical to SEQ ID NO: 110
  Synthetic Polypeptide

SEQ ID NO: 654 - protein, 452 aa, Artificial Sequence
  Synthetic Polypeptide
QVQLVQSGAEVKKPGSSVKVSCKASGFTFSSYGMHWVRQAPGQGLEWMGLIWFDESNIYYADKFQGRVTITRDNAKNTLYMELSSLRSEDTAVYFCARGYDLLTGYYNFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 655 - protein, 214 aa, Artificial Sequence
  Synthetic Polypeptide
DIQMTQSPSSLSASVGDRVTITCRASQSIGSSLHWYQQKPGKAPKLLIYYVSQSFSGVPSRFSGSGSGTDFTLTISSLQPEDFATYYCHQSSSLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 656 - protein, 457 aa, Artificial Sequence
  Synthetic Polypeptide
QVQLQESGPGLVKPSQTLSLTCTVSGGSISSVYFYWNWIRQHPGKGLEWIGYIYYSGGTYYNPSLRSRVTISVDTSKNQFSLKLSSVTAADTAVYYCARGSIAAGGGYFYYNDMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 657 - protein, 214 aa, Artificial Sequence
  Synthetic Polypeptide
DIQLTQSPSSLSASVGDRVTITCRASQSIGSSLHWYQQKPGKAPKPLIKYVSQSFSGVPSRFSGSGSGTDFTLTISSLQPEDFATYYCHQSSSLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 658 - protein, 457 aa, Artificial Sequence
  Synthetic Polypeptide
QVQLQESGPGLVKPSQTLSLTCTVSGGSISSVYFYWNWIRQHPGKGLEWIGYIYYSGGTYYNPSLKSRVTISVDTSKNQFSLKLSSVTAADTAVYYCARGSIAAGGGYFYYNDMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 659 - protein, 214 aa, Artificial Sequence
  Synthetic Polypeptide
EIVLTQSPATLSLSPGERATLSCRASQSIGSSLHWYQQKPGQAPRLLIYYVSQSFSGIPARFSGSGSGTDFTLTISSLEPEDFAVYYCHQSSSLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 660 - protein, 457 aa, Artificial Sequence; identical to SEQ ID NO: 656
  Synthetic Polypeptide

SEQ ID NO: 661 - protein, 214 aa, Artificial Sequence
  Synthetic Polypeptide
DIQMTQSPSSLSASVGDRVTITCRASQGIRYEAGWYQQKPGKAPKRLIYAASSLQSGVPSRFSGSGSGTEFTLTISSLQPEDFATYYCLQLLAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 662 - protein, 448 aa, Artificial Sequence
  Synthetic Polypeptide
QVQLVQSGAEVKKPGASVKVSCKASGYTFTDYFIYWVRQAPGQGLEWMGWIEPNAGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 663 - protein, 214 aa, Artificial Sequence; identical to SEQ ID NO: 661
  Synthetic Polypeptide

SEQ ID NO: 664 - protein, 448 aa, Artificial Sequence
  Synthetic Polypeptide
QVQLVQSGAEVKKPGASVKVSCKASGYTFTDYYIYWVRQAPGQGLEWMGWAEPNAGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 665 - protein, 214 aa, Artificial Sequence; identical to SEQ ID NO: 661
  Synthetic Polypeptide

SEQ ID NO: 666 - protein, 448 aa, Artificial Sequence
  Synthetic Polypeptide
QVQLVQSGAEVKKPGASVKVSCKASGYTFTDYFIYWVRQAPGQGLEWMGWINPNAGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 667 - protein, 214 aa, Artificial Sequence; identical to SEQ ID NO: 661
  Synthetic Polypeptide

SEQ ID NO: 668 - protein, 448 aa, Artificial Sequence
  Synthetic Polypeptide
QVQLVQSGAEVKKPGASVKVSCKASGYTFTDYYIYWVRQAPGQGLEWMGWIEPNAGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 669 - protein, 214 aa, Artificial Sequence; identical to SEQ ID NO: 661
  Synthetic Polypeptide

SEQ ID NO: 670 - protein, 448 aa, Artificial Sequence; identical to SEQ ID NO: 19
  Synthetic Polypeptide

SEQ ID NO: 671 - protein, 214 aa, Artificial Sequence
  Synthetic Polypeptide
DIQMTQSPSSLSASVGDRVTITCRASQGIRYEAGWYQQKPGKAPKRLIYAASSLQSGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 672 - protein, 448 aa, Artificial Sequence
  Synthetic Polypeptide
QVQLVQSGAEVKKPGASVKVSCKASGYTFTDYFIYWVRQAPGQGLEWMGWAEPNAGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 673 - protein, 214 aa, Artificial Sequence; identical to SEQ ID NO: 671
  Synthetic Polypeptide

SEQ ID NO: 674 - protein, 448 aa, Artificial Sequence; identical to SEQ ID NO: 662
  Synthetic Polypeptide

SEQ ID NO: 675 - protein, 214 aa, Artificial Sequence; identical to SEQ ID NO: 671
  Synthetic Polypeptide

SEQ ID NO: 676 - protein, 448 aa, Artificial Sequence; identical to SEQ ID NO: 664
  Synthetic Polypeptide

SEQ ID NO: 677 - protein, 214 aa, Artificial Sequence; identical to SEQ ID NO: 671
  Synthetic Polypeptide

SEQ ID NO: 678 - protein, 448 aa, Artificial Sequence; identical to SEQ ID NO: 666
  Synthetic Polypeptide

SEQ ID NO: 679 - protein, 214 aa, Artificial Sequence; identical to SEQ ID NO: 671
  Synthetic Polypeptide

SEQ ID NO: 680 - protein, 448 aa, Artificial Sequence
  Synthetic Polypeptide
QVQLVQSGAEVKKPGASVKVSCKASGYTFTDYYIYWVRQAPGQGLEWMGWANPNAGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 681 - protein, 214 aa, Artificial Sequence; identical to SEQ ID NO: 671
  Synthetic Polypeptide

SEQ ID NO: 682 - protein, 448 aa, Artificial Sequence; identical to SEQ ID NO: 668
  Synthetic Polypeptide

SEQ ID NO: 683 - protein, 214 aa, Artificial Sequence; identical to SEQ ID NO: 671
  Synthetic Polypeptide

SEQ ID NO: 684 - protein, 448 aa, Artificial Sequence; identical to SEQ ID NO: 19
  Synthetic Polypeptide

SEQ ID NO: 685 - protein, 214 aa, Artificial Sequence
  Synthetic Polypeptide
DIQMTQSPSSLSASVGDRVTITCRASQGIRYDAGWYQQKPGKAPKRLIYAASSLQSGVPSRFSGSGSGTEFTLTISSLQPEDFATYYCLQLLAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 686 - protein, 448 aa, Artificial Sequence; identical to SEQ ID NO: 662
  Synthetic Polypeptide

SEQ ID NO: 687 - protein, 214 aa, Artificial Sequence; identical to SEQ ID NO: 685
  Synthetic Polypeptide

SEQ ID NO: 688 - protein, 448 aa, Artificial Sequence; identical to SEQ ID NO: 664
  Synthetic Polypeptide

SEQ ID NO: 689 - protein, 214 aa, Artificial Sequence; identical to SEQ ID NO: 685
  Synthetic Polypeptide

SEQ ID NO: 690 - protein, 448 aa, Artificial Sequence; identical to SEQ ID NO: 666
  Synthetic Polypeptide

SEQ ID NO: 691 - protein, 214 aa, Artificial Sequence; identical to SEQ ID NO: 685
  Synthetic Polypeptide

SEQ ID NO: 692 - protein, 448 aa, Artificial Sequence; identical to SEQ ID NO: 668
  Synthetic Polypeptide

SEQ ID NO: 693 - protein, 214 aa, Artificial Sequence; identical to SEQ ID NO: 685
  Synthetic Polypeptide

SEQ ID NO: 694 - protein, 448 aa, Artificial Sequence; identical to SEQ ID NO: 19
  Synthetic Polypeptide

SEQ ID NO: 695 - protein, 214 aa, Artificial Sequence
  Synthetic Polypeptide
DIQMTQSPSSLSASVGDRVTITCRASQGIRNEAGWYQQKPGKAPKRLIYAASSLQSGVPSRFSGSGSGTEFTLTISSLQPEDFATYYCLQLLAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 696 - protein, 448 aa, Artificial Sequence; identical to SEQ ID NO: 672
  Synthetic Polypeptide

SEQ ID NO: 697 - protein, 214 aa, Artificial Sequence; identical to SEQ ID NO: 695
  Synthetic Polypeptide

SEQ ID NO: 698 - protein, 448 aa, Artificial Sequence; identical to SEQ ID NO: 662
  Synthetic Polypeptide

SEQ ID NO: 699 - protein, 214 aa, Artificial Sequence; identical to SEQ ID NO: 695
  Synthetic Polypeptide

SEQ ID NO: 700 - protein, 448 aa, Artificial Sequence
  Synthetic Polypeptide
QVQLVQSGAEVKKPGASVKVSCKASGYTFTDYFIYWVRQAPGQGLEWMGWANPNAGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 701 - protein, 214 aa, Artificial Sequence; identical to SEQ ID NO: 695
  Synthetic Polypeptide

SEQ ID NO: 702 - protein, 448 aa, Artificial Sequence; identical to SEQ ID NO: 664
  Synthetic Polypeptide

SEQ ID NO: 703 - protein, 214 aa, Artificial Sequence; identical to SEQ ID NO: 695
  Synthetic Polypeptide

SEQ ID NO: 704 - protein, 448 aa, Artificial Sequence; identical to SEQ ID NO: 666
  Synthetic Polypeptide

SEQ ID NO: 705 - protein, 214 aa, Artificial Sequence; identical to SEQ ID NO: 695
  Synthetic Polypeptide

SEQ ID NO: 706 - protein, 448 aa, Artificial Sequence; identical to SEQ ID NO: 680
  Synthetic Polypeptide

SEQ ID NO: 707 - protein, 214 aa, Artificial Sequence; identical to SEQ ID NO: 695
  Synthetic Polypeptide

SEQ ID NO: 708 - protein, 448 aa, Artificial Sequence; identical to SEQ ID NO: 668
  Synthetic Polypeptide

SEQ ID NO: 709 - protein, 214 aa, Artificial Sequence; identical to SEQ ID NO: 695
  Synthetic Polypeptide

SEQ ID NO: 710 - protein, 448 aa, Artificial Sequence; identical to SEQ ID NO: 19
  Synthetic Polypeptide

SEQ ID NO: 711 - protein, 214 aa, Artificial Sequence
  Synthetic Polypeptide
DIQMTQSPSSLSASVGDRVTITCRASQGIRYELGWYQQKPGKAPKRLIYAASSLQSGVPSRFSGSGSGTEFTLTISSLQPEDFATYYCLQLLAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 712 - protein, 448 aa, Artificial Sequence; identical to SEQ ID NO: 672
  Synthetic Polypeptide

SEQ ID NO: 713 - protein, 214 aa, Artificial Sequence; identical to SEQ ID NO: 711
  Synthetic Polypeptide

SEQ ID NO: 714 - protein, 448 aa, Artificial Sequence; identical to SEQ ID NO: 662
  Synthetic Polypeptide

SEQ ID NO: 715 - protein, 214 aa, Artificial Sequence; identical to SEQ ID NO: 711
  Synthetic Polypeptide

SEQ ID NO: 716 - protein, 448 aa, Artificial Sequence; identical to SEQ ID NO: 700
  Synthetic Polypeptide

SEQ ID NO: 717 - protein, 214 aa, Artificial Sequence; identical to SEQ ID NO: 711
  Synthetic Polypeptide

SEQ ID NO: 718 - protein, 448 aa, Artificial Sequence; identical to SEQ ID NO: 664
  Synthetic Polypeptide

SEQ ID NO: 719 - protein, 214 aa, Artificial Sequence; identical to SEQ ID NO: 711
  Synthetic Polypeptide

SEQ ID NO: 720 - protein, 448 aa, Artificial Sequence; identical to SEQ ID NO: 666
  Synthetic Polypeptide

SEQ ID NO: 721 - protein, 214 aa, Artificial Sequence; identical to SEQ ID NO: 711
  Synthetic Polypeptide

SEQ ID NO: 722 - protein, 448 aa, Artificial Sequence; identical to SEQ ID NO: 680
  Synthetic Polypeptide

SEQ ID NO: 723 - protein, 214 aa, Artificial Sequence; identical to SEQ ID NO: 711
  Synthetic Polypeptide

SEQ ID NO: 724 - protein, 448 aa, Artificial Sequence; identical to SEQ ID NO: 668
  Synthetic Polypeptide

SEQ ID NO: 725 - protein, 214 aa, Artificial Sequence; identical to SEQ ID NO: 711
  Synthetic Polypeptide

SEQ ID NO: 726 - protein, 448 aa, Artificial Sequence; identical to SEQ ID NO: 19
  Synthetic Polypeptide

SEQ ID NO: 727 - protein, 214 aa, Artificial Sequence
  Synthetic Polypeptide
DIQMTQSPSSLSASVGDRVTITCRASQGIRYELGWYQQKPGKAPKRLIYAASSLQSGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 728 - protein, 448 aa, Artificial Sequence; identical to SEQ ID NO: 672
  Synthetic Polypeptide

SEQ ID NO: 729 - protein, 214 aa, Artificial Sequence; identical to SEQ ID NO: 727
  Synthetic Polypeptide

SEQ ID NO: 730 - protein, 448 aa, Artificial Sequence; identical to SEQ ID NO: 662
  Synthetic Polypeptide

SEQ ID NO: 731 - protein, 214 aa, Artificial Sequence; identical to SEQ ID NO: 727
  Synthetic Polypeptide

SEQ ID NO: 732 - protein, 448 aa, Artificial Sequence; identical to SEQ ID NO: 700
  Synthetic Polypeptide

SEQ ID NO: 733 - protein, 214 aa, Artificial Sequence; identical to SEQ ID NO: 727
  Synthetic Polypeptide

SEQ ID NO: 734 - protein, 448 aa, Artificial Sequence; identical to SEQ ID NO: 664
  Synthetic Polypeptide

SEQ ID NO: 735 - protein, 214 aa, Artificial Sequence; identical to SEQ ID NO: 727
  Synthetic Polypeptide

SEQ ID NO: 736 - protein, 448 aa, Artificial Sequence; identical to SEQ ID NO: 666
  Synthetic Polypeptide

SEQ ID NO: 737 - protein, 214 aa, Artificial Sequence; identical to SEQ ID NO: 727
  Synthetic Polypeptide

SEQ ID NO: 738 - protein, 448 aa, Artificial Sequence; identical to SEQ ID NO: 680
  Synthetic Polypeptide

SEQ ID NO: 739 - protein, 214 aa, Artificial Sequence; identical to SEQ ID NO: 727
  Synthetic Polypeptide

SEQ ID NO: 740 - protein, 448 aa, Artificial Sequence; identical to SEQ ID NO: 668
  Synthetic Polypeptide

SEQ ID NO: 741 - protein, 214 aa, Artificial Sequence; identical to SEQ ID NO: 727
  Synthetic Polypeptide

SEQ ID NO: 742 - protein, 448 aa, Artificial Sequence; identical to SEQ ID NO: 19
  Synthetic Polypeptide

SEQ ID NO: 743 - protein, 214 aa, Artificial Sequence
  Synthetic Polypeptide
DIQMTQSPSSLSASVGDRVTITCRASQGIRYDAGWYQQKPGKAPKRLIYAASSLQSGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 744 - protein, 448 aa, Artificial Sequence; identical to SEQ ID NO: 672
  Synthetic Polypeptide

SEQ ID NO: 745 - protein, 214 aa, Artificial Sequence; identical to SEQ ID NO: 743
  Synthetic Polypeptide

SEQ ID NO: 746 - protein, 448 aa, Artificial Sequence; identical to SEQ ID NO: 662
  Synthetic Polypeptide

SEQ ID NO: 747 - protein, 214 aa, Artificial Sequence; identical to SEQ ID NO: 743
  Synthetic Polypeptide

SEQ ID NO: 748 - protein, 448 aa, Artificial Sequence; identical to SEQ ID NO: 700
  Synthetic Polypeptide

SEQ ID NO: 749 - protein, 214 aa, Artificial Sequence; identical to SEQ ID NO: 743
  Synthetic Polypeptide

SEQ ID NO: 750 - protein, 448 aa, Artificial Sequence; identical to SEQ ID NO: 664
  Synthetic Polypeptide

SEQ ID NO: 751 - protein, 214 aa, Artificial Sequence; identical to SEQ ID NO: 743
  Synthetic Polypeptide

SEQ ID NO: 752 - protein, 448 aa, Artificial Sequence; identical to SEQ ID NO: 666
  Synthetic Polypeptide

SEQ ID NO: 753 - protein, 214 aa, Artificial Sequence; identical to SEQ ID NO: 743
  Synthetic Polypeptide

SEQ ID NO: 754 - protein, 448 aa, Artificial Sequence; identical to SEQ ID NO: 680
  Synthetic Polypeptide

SEQ ID NO: 755 - protein, 214 aa, Artificial Sequence; identical to SEQ ID NO: 743
  Synthetic Polypeptide

SEQ ID NO: 756 - protein, 448 aa, Artificial Sequence; identical to SEQ ID NO: 668
  Synthetic Polypeptide

SEQ ID NO: 757 - protein, 214 aa, Artificial Sequence; identical to SEQ ID NO: 743
  Synthetic Polypeptide

SEQ ID NO: 758 - protein, 448 aa, Artificial Sequence; identical to SEQ ID NO: 19
  Synthetic Polypeptide

SEQ ID NO: 759 - protein, 214 aa, Artificial Sequence
  Synthetic Polypeptide
DIQMTQSPSSLSASVGDRVTITCRASQGIRYDLGWYQQKPGKAPKRLIYAASSLQSGVPSRFSGSGSGTEFTLTISSLQPEDFATYYCLQLLAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 760 - protein, 448 aa, Artificial Sequence; identical to SEQ ID NO: 672
  Synthetic Polypeptide

SEQ ID NO: 761 - protein, 214 aa, Artificial Sequence; identical to SEQ ID NO: 759
  Synthetic Polypeptide

SEQ ID NO: 762 - protein, 448 aa, Artificial Sequence; identical to SEQ ID NO: 662
  Synthetic Polypeptide

SEQ ID NO: 763 - protein, 214 aa, Artificial Sequence; identical to SEQ ID NO: 759
  Synthetic Polypeptide

SEQ ID NO: 764 - protein, 448 aa, Artificial Sequence; identical to SEQ ID NO: 700
  Synthetic Polypeptide

SEQ ID NO: 765 - protein, 214 aa, Artificial Sequence; identical to SEQ ID NO: 759
  Synthetic Polypeptide

SEQ ID NO: 766 - protein, 448 aa, Artificial Sequence; identical to SEQ ID NO: 664
  Synthetic Polypeptide

SEQ ID NO: 767 - protein, 214 aa, Artificial Sequence; identical to SEQ ID NO: 759
  Synthetic Polypeptide

SEQ ID NO: 768 - protein, 448 aa, Artificial Sequence; identical to SEQ ID NO: 666
  Synthetic Polypeptide

SEQ ID NO: 769 - protein, 214 aa, Artificial Sequence; identical to SEQ ID NO: 759
  Synthetic Polypeptide

SEQ ID NO: 770 - protein, 448 aa, Artificial Sequence; identical to SEQ ID NO: 680
  Synthetic Polypeptide

SEQ ID NO: 771 - protein, 214 aa, Artificial Sequence; identical to SEQ ID NO: 759
  Synthetic Polypeptide

SEQ ID NO: 772 - protein, 448 aa, Artificial Sequence; identical to SEQ ID NO: 668
  Synthetic Polypeptide

SEQ ID NO: 773 - protein, 214 aa, Artificial Sequence; identical to SEQ ID NO: 759
  Synthetic Polypeptide

SEQ ID NO: 774 - protein, 448 aa, Artificial Sequence; identical to SEQ ID NO: 19
  Synthetic Polypeptide

SEQ ID NO: 775 - protein, 214 aa, Artificial Sequence
  Synthetic Polypeptide
DIQMTQSPSSLSASVGDRVTITCRASQGIRNEAGWYQQKPGKAPKRLIYAASSLQSGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 776 - protein, 448 aa, Artificial Sequence; identical to SEQ ID NO: 672
  Synthetic Polypeptide

SEQ ID NO: 777 - protein, 214 aa, Artificial Sequence; identical to SEQ ID NO: 775
  Synthetic Polypeptide

SEQ ID NO: 778 - protein, 448 aa, Artificial Sequence; identical to SEQ ID NO: 662
  Synthetic Polypeptide

SEQ ID NO: 779 - protein, 214 aa, Artificial Sequence; identical to SEQ ID NO: 775
  Synthetic Polypeptide

SEQ ID NO: 780 - protein, 448 aa, Artificial Sequence; identical to SEQ ID NO: 700
  Synthetic Polypeptide

SEQ ID NO: 781 - protein, 214 aa, Artificial Sequence; identical to SEQ ID NO: 775
  Synthetic Polypeptide

SEQ ID NO: 782 - protein, 448 aa, Artificial Sequence; identical to SEQ ID NO: 664
  Synthetic Polypeptide

SEQ ID NO: 783 - protein, 214 aa, Artificial Sequence; identical to SEQ ID NO: 775
  Synthetic Polypeptide

SEQ ID NO: 784 - protein, 448 aa, Artificial Sequence; identical to SEQ ID NO: 666
  Synthetic Polypeptide

SEQ ID NO: 785 - protein, 214 aa, Artificial Sequence; identical to SEQ ID NO: 775
  Synthetic Polypeptide

SEQ ID NO: 786 - protein, 448 aa, Artificial Sequence; identical to SEQ ID NO: 680
  Synthetic Polypeptide

SEQ ID NO: 787 - protein, 214 aa, Artificial Sequence; identical to SEQ ID NO: 775
  Synthetic Polypeptide

SEQ ID NO: 788 - protein, 448 aa, Artificial Sequence; identical to SEQ ID NO: 668
  Synthetic Polypeptide

SEQ ID NO: 789 - protein, 214 aa, Artificial Sequence; identical to SEQ ID NO: 775
  Synthetic Polypeptide

SEQ ID NO: 790 - protein, 448 aa, Artificial Sequence; identical to SEQ ID NO: 19
  Synthetic Polypeptide

SEQ ID NO: 791 - protein, 214 aa, Artificial Sequence
  Synthetic Polypeptide
DIQMTQSPSSLSASVGDRVTITCRASQGIRNELGWYQQKPGKAPKRLIYAASSLQSGVPSRFSGSGSGTEFTLTISSLQPEDFATYYCLQLLAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 792 - protein, 448 aa, Artificial Sequence; identical to SEQ ID NO: 672
  Synthetic Polypeptide

SEQ ID NO: 793 - protein, 214 aa, Artificial Sequence; identical to SEQ ID NO: 791
  Synthetic Polypeptide

SEQ ID NO: 794 - protein, 448 aa, Artificial Sequence; identical to SEQ ID NO: 662
  Synthetic Polypeptide

SEQ ID NO: 795 - protein, 214 aa, Artificial Sequence; identical to SEQ ID NO: 791
  Synthetic Polypeptide

SEQ ID NO: 796 - protein, 448 aa, Artificial Sequence; identical to SEQ ID NO: 700
  Synthetic Polypeptide

SEQ ID NO: 797 - protein, 214 aa, Artificial Sequence; identical to SEQ ID NO: 791
  Synthetic Polypeptide

SEQ ID NO: 798 - protein, 448 aa, Artificial Sequence; identical to SEQ ID NO: 664
  Synthetic Polypeptide

SEQ ID NO: 799 - protein, 214 aa, Artificial Sequence; identical to SEQ ID NO: 791
  Synthetic Polypeptide

SEQ ID NO: 800 - protein, 448 aa, Artificial Sequence; identical to SEQ ID NO: 666
  Synthetic Polypeptide

SEQ ID NO: 801 - protein, 214 aa, Artificial Sequence; identical to SEQ ID NO: 791
  Synthetic Polypeptide

SEQ ID NO: 802 - protein, 448 aa, Artificial Sequence; identical to SEQ ID NO: 680
  Synthetic Polypeptide

SEQ ID NO: 803 - protein, 214 aa, Artificial Sequence; identical to SEQ ID NO: 791
  Synthetic Polypeptide

SEQ ID NO: 804 - protein, 448 aa, Artificial Sequence; identical to SEQ ID NO: 668
  Synthetic Polypeptide

SEQ ID NO: 805 - protein, 214 aa, Artificial Sequence; identical to SEQ ID NO: 791
  Synthetic Polypeptide

SEQ ID NO: 806 - protein, 448 aa, Artificial Sequence; identical to SEQ ID NO: 19
  Synthetic Polypeptide

SEQ ID NO: 807 - protein, 214 aa, Artificial Sequence
  Synthetic Polypeptide
DIQMTQSPSSLSASVGDRVTITCRASQGIRNDAGWYQQKPGKAPKRLIYAASSLQSGVPSRFSGSGSGTEFTLTISSLQPEDFATYYCLQLLAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 808 - protein, 448 aa, Artificial Sequence; identical to SEQ ID NO: 662
  Synthetic Polypeptide

SEQ ID NO: 809 - protein, 214 aa, Artificial Sequence; identical to SEQ ID NO: 807
  Synthetic Polypeptide

SEQ ID NO: 810 - protein, 448 aa, Artificial Sequence; identical to SEQ ID NO: 664
  Synthetic Polypeptide

SEQ ID NO: 811 - protein, 214 aa, Artificial Sequence; identical to SEQ ID NO: 807
  Synthetic Polypeptide

SEQ ID NO: 812 - protein, 448 aa, Artificial Sequence; identical to SEQ ID NO: 666
  Synthetic Polypeptide

SEQ ID NO: 813 - protein, 214 aa, Artificial Sequence; identical to SEQ ID NO: 807
  Synthetic Polypeptide

SEQ ID NO: 814 - protein, 448 aa, Artificial Sequence; identical to SEQ ID NO: 668
  Synthetic Polypeptide

SEQ ID NO: 815 - protein, 214 aa, Artificial Sequence; identical to SEQ ID NO: 807
  Synthetic Polypeptide

SEQ ID NO: 816 - protein, 448 aa, Artificial Sequence; identical to SEQ ID NO: 19
  Synthetic Polypeptide

SEQ ID NO: 817 - protein, 214 aa, Artificial Sequence
  Synthetic Polypeptide
DIQMTQSPSSLSASVGDRVTITCRASQGIRYDLGWYQQKPGKAPKRLIYAASSLQSGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 818 - protein, 448 aa, Artificial Sequence; identical to SEQ ID NO: 672
  Synthetic Polypeptide

SEQ ID NO: 819 - protein, 214 aa, Artificial Sequence; identical to SEQ ID NO: 817
  Synthetic Polypeptide

SEQ ID NO: 820 - protein, 448 aa, Artificial Sequence; identical to SEQ ID NO: 662
  Synthetic Polypeptide

SEQ ID NO: 821 - protein, 214 aa, Artificial Sequence; identical to SEQ ID NO: 817
  Synthetic Polypeptide

SEQ ID NO: 822 - protein, 448 aa, Artificial Sequence; identical to SEQ ID NO: 700
  Synthetic Polypeptide

SEQ ID NO: 823 - protein, 214 aa, Artificial Sequence; identical to SEQ ID NO: 817
  Synthetic Polypeptide

SEQ ID NO: 824 - protein, 448 aa, Artificial Sequence; identical to SEQ ID NO: 664
  Synthetic Polypeptide

SEQ ID NO: 825 - protein, 214 aa, Artificial Sequence; identical to SEQ ID NO: 817
  Synthetic Polypeptide

SEQ ID NO: 826 - protein, 448 aa, Artificial Sequence; identical to SEQ ID NO: 666
  Synthetic Polypeptide

SEQ ID NO: 827 - protein, 214 aa, Artificial Sequence; identical to SEQ ID NO: 817
  Synthetic Polypeptide

SEQ ID NO: 828 - protein, 448 aa, Artificial Sequence; identical to SEQ ID NO: 680
  Synthetic Polypeptide

SEQ ID NO: 829 - protein, 214 aa, Artificial Sequence; identical to SEQ ID NO: 817
  Synthetic Polypeptide

SEQ ID NO: 830 - protein, 448 aa, Artificial Sequence; identical to SEQ ID NO: 668
  Synthetic Polypeptide

SEQ ID NO: 831 - protein, 214 aa, Artificial Sequence; identical to SEQ ID NO: 817
  Synthetic Polypeptide

SEQ ID NO: 832 - protein, 448 aa, Artificial Sequence; identical to SEQ ID NO: 19
  Synthetic Polypeptide

SEQ ID NO: 833 - protein, 214 aa, Artificial Sequence
  Synthetic Polypeptide
DIQMTQSPSSLSASVGDRVTITCRASQGIRNELGWYQQKPGKAPKRLIYAASSLQSGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 834 - protein, 448 aa, Artificial Sequence; identical to SEQ ID NO: 672
  Synthetic Polypeptide

SEQ ID NO: 835 - protein, 214 aa, Artificial Sequence; identical to SEQ ID NO: 833
  Synthetic Polypeptide

SEQ ID NO: 836 - protein, 448 aa, Artificial Sequence; identical to SEQ ID NO: 662
  Synthetic Polypeptide

SEQ ID NO: 837 - protein, 214 aa, Artificial Sequence; identical to SEQ ID NO: 833
  Synthetic Polypeptide

SEQ ID NO: 838 - protein, 448 aa, Artificial Sequence; identical to SEQ ID NO: 700
  Synthetic Polypeptide

SEQ ID NO: 839 - protein, 214 aa, Artificial Sequence; identical to SEQ ID NO: 833
  Synthetic Polypeptide

SEQ ID NO: 840 - protein, 448 aa, Artificial Sequence; identical to SEQ ID NO: 664
  Synthetic Polypeptide

SEQ ID NO: 841 - protein, 214 aa, Artificial Sequence; identical to SEQ ID NO: 833
  Synthetic Polypeptide

SEQ ID NO: 842 - protein, 448 aa, Artificial Sequence; identical to SEQ ID NO: 666
  Synthetic Polypeptide

SEQ ID NO: 843 - protein, 214 aa, Artificial Sequence; identical to SEQ ID NO: 833
  Synthetic Polypeptide

SEQ ID NO: 844 - protein, 448 aa, Artificial Sequence; identical to SEQ ID NO: 680
  Synthetic Polypeptide

SEQ ID NO: 845 - protein, 214 aa, Artificial Sequence; identical to SEQ ID NO: 833
  Synthetic Polypeptide

SEQ ID NO: 846 - protein, 448 aa, Artificial Sequence; identical to SEQ ID NO: 668
  Synthetic Polypeptide

SEQ ID NO: 847 - protein, 214 aa, Artificial Sequence; identical to SEQ ID NO: 833
  Synthetic Polypeptide

SEQ ID NO: 848 - protein, 448 aa, Artificial Sequence; identical to SEQ ID NO: 19
  Synthetic Polypeptide

SEQ ID NO: 849 - protein, 214 aa, Artificial Sequence
  Synthetic Polypeptide
DIQMTQSPSSLSASVGDRVTITCRASQGIRNDAGWYQQKPGKAPKRLIYAASSLQSGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 850 - protein, 448 aa, Artificial Sequence; identical to SEQ ID NO: 672
  Synthetic Polypeptide

SEQ ID NO: 851 - protein, 214 aa, Artificial Sequence; identical to SEQ ID NO: 849
  Synthetic Polypeptide

SEQ ID NO: 852 - protein, 448 aa, Artificial Sequence; identical to SEQ ID NO: 662
  Synthetic Polypeptide

SEQ ID NO: 853 - protein, 214 aa, Artificial Sequence; identical to SEQ ID NO: 849
  Synthetic Polypeptide

SEQ ID NO: 854 - protein, 448 aa, Artificial Sequence; identical to SEQ ID NO: 700
  Synthetic Polypeptide

SEQ ID NO: 855 - protein, 214 aa, Artificial Sequence; identical to SEQ ID NO: 849
  Synthetic Polypeptide

SEQ ID NO: 856 - protein, 448 aa, Artificial Sequence; identical to SEQ ID NO: 664
  Synthetic Polypeptide

SEQ ID NO: 857 - protein, 214 aa, Artificial Sequence; identical to SEQ ID NO: 849
  Synthetic Polypeptide

SEQ ID NO: 858 - protein, 448 aa, Artificial Sequence; identical to SEQ ID NO: 666
  Synthetic Polypeptide

SEQ ID NO: 859 - protein, 214 aa, Artificial Sequence; identical to SEQ ID NO: 849
  Synthetic Polypeptide

SEQ ID NO: 860 - protein, 448 aa, Artificial Sequence; identical to SEQ ID NO: 680
  Synthetic Polypeptide

SEQ ID NO: 861 - protein, 214 aa, Artificial Sequence; identical to SEQ ID NO: 849
  Synthetic Polypeptide

SEQ ID NO: 862 - protein, 448 aa, Artificial Sequence; identical to SEQ ID NO: 668
  Synthetic Polypeptide

SEQ ID NO: 863 - protein, 214 aa, Artificial Sequence; identical to SEQ ID NO: 849
  Synthetic Polypeptide

SEQ ID NO: 864 - protein, 448 aa, Artificial Sequence; identical to SEQ ID NO: 19
  Synthetic Polypeptide

SEQ ID NO: 865 - protein, 214 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQLLAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 866 - protein, 448 aa, Artificial Sequence; identical to SEQ ID NO: 672
  Synthetic Polypeptide

SEQ ID NO: 867 - protein, 214 aa, Artificial Sequence; identical to SEQ ID NO: 865
  Synthetic Polypeptide

SEQ ID NO: 868 - protein, 448 aa, Artificial Sequence; identical to SEQ ID NO: 662
  Synthetic Polypeptide

SEQ ID NO: 869 - protein, 214 aa, Artificial Sequence; identical to SEQ ID NO: 865
  Synthetic Polypeptide

SEQ ID NO: 870 - protein, 448 aa, Artificial Sequence; identical to SEQ ID NO: 700
  Synthetic Polypeptide

SEQ ID NO: 871 - protein, 214 aa, Artificial Sequence; identical to SEQ ID NO: 865
  Synthetic Polypeptide

SEQ ID NO: 872 - protein, 448 aa, Artificial Sequence; identical to SEQ ID NO: 664
  Synthetic Polypeptide

SEQ ID NO: 873 - protein, 214 aa, Artificial Sequence; identical to SEQ ID NO: 865
  Synthetic Polypeptide

SEQ ID NO: 874 - protein, 448 aa, Artificial Sequence; identical to SEQ ID NO: 666
  Synthetic Polypeptide

SEQ ID NO: 875 - protein, 214 aa, Artificial Sequence; identical to SEQ ID NO: 865
  Synthetic Polypeptide

SEQ ID NO: 876 - protein, 448 aa, Artificial Sequence; identical to SEQ ID NO: 680
  Synthetic Polypeptide

SEQ ID NO: 877 - protein, 214 aa, Artificial Sequence; identical to SEQ ID NO: 865
  Synthetic Polypeptide

SEQ ID NO: 878 - protein, 448 aa, Artificial Sequence; identical to SEQ ID NO: 668
  Synthetic Polypeptide

SEQ ID NO: 879 - protein, 214 aa, Artificial Sequence; identical to SEQ ID NO: 865
  Synthetic Polypeptide

SEQ ID NO: 880 - protein, 448 aa, Artificial Sequence; identical to SEQ ID NO: 19
  Synthetic Polypeptide

SEQ ID NO: 881 - protein, 214 aa, Artificial Sequence; identical to SEQ ID NO: 20
  Synthetic Polypeptide

SEQ ID NO: 882 - protein, 448 aa, Artificial Sequence; identical to SEQ ID NO: 672
  Synthetic Polypeptide

SEQ ID NO: 883 - protein, 214 aa, Artificial Sequence; identical to SEQ ID NO: 20
  Synthetic Polypeptide

SEQ ID NO: 884 - protein, 448 aa, Artificial Sequence; identical to SEQ ID NO: 662
  Synthetic Polypeptide

SEQ ID NO: 885 - protein, 214 aa, Artificial Sequence; identical to SEQ ID NO: 20
  Synthetic Polypeptide

SEQ ID NO: 886 - protein, 448 aa, Artificial Sequence; identical to SEQ ID NO: 700
  Synthetic Polypeptide

SEQ ID NO: 887 - protein, 214 aa, Artificial Sequence; identical to SEQ ID NO: 20
  Synthetic Polypeptide

SEQ ID NO: 888 - protein, 448 aa, Artificial Sequence; identical to SEQ ID NO: 664
  Synthetic Polypeptide

SEQ ID NO: 889 - protein, 214 aa, Artificial Sequence; identical to SEQ ID NO: 20
  Synthetic Polypeptide

SEQ ID NO: 890 - protein, 448 aa, Artificial Sequence; identical to SEQ ID NO: 666
  Synthetic Polypeptide

SEQ ID NO: 891 - protein, 214 aa, Artificial Sequence; identical to SEQ ID NO: 20
  Synthetic Polypeptide

SEQ ID NO: 892 - protein, 448 aa, Artificial Sequence; identical to SEQ ID NO: 680
  Synthetic Polypeptide

SEQ ID NO: 893 - protein, 214 aa, Artificial Sequence; identical to SEQ ID NO: 20
  Synthetic Polypeptide

SEQ ID NO: 894 - protein, 448 aa, Artificial Sequence; identical to SEQ ID NO: 668
  Synthetic Polypeptide

SEQ ID NO: 895 - protein, 214 aa, Artificial Sequence
  Synthetic Polypeptide
DIQMTQSPSSLSASVGDRVTITCRASQGIRNDLGWYQQKPGKAPKRLIYAAKLTQSGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 896 - protein, 448 aa, Artificial Sequence
  Synthetic Polypeptide
QVQLVQSGAEVKKPGASVKVSCKASGYTFTDYYIYWVRQAPGQGLEWMGWINPNAGGTNYAQLKPGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 897 - protein, 214 aa, Artificial Sequence; identical to SEQ ID NO: 20
  Synthetic Polypeptide

SEQ ID NO: 898 - protein, 448 aa, Artificial Sequence
  Synthetic Polypeptide
QVQLVQSGAEVKKPGASVKVSCKASGYTFTDYYIYWVRQAPGQGLEWMGWINPNAGGTNYRDKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 899 - protein, 214 aa, Artificial Sequence
  Synthetic Polypeptide
DIQMTQSPSSLSASVGDRVTITCRASQGIRNDLGWYQQKPGKAPKRLIYAAQLRQSGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 900 - protein, 448 aa, Artificial Sequence; identical to SEQ ID NO: 896
  Synthetic Polypeptide

SEQ ID NO: 901 - protein, 214 aa, Artificial Sequence; identical to SEQ ID NO: 895
  Synthetic Polypeptide

SEQ ID NO: 902 - protein, 448 aa, Artificial Sequence
  Synthetic Polypeptide
QVQLVQSGAEVKKPGASVKVSCKASGYTFTDYYIYWVRQAPGQGLEWMGWINPNAGGTNYAQRKPGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 903 - protein, 214 aa, Artificial Sequence
  Synthetic Polypeptide
DIQMTQSPSSLSASVGDRVTITCRASQGIRNDLGWYQQKPGKAPKRLIYAASSNPYGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 904 - protein, 448 aa, Artificial Sequence; identical to SEQ ID NO: 19
  Synthetic Polypeptide

SEQ ID NO: 905 - protein, 214 aa, Artificial Sequence
  Synthetic Polypeptide
DIQMTQSPSSLSASVGDRVTITCRASRGIRNDLGWYQQKPGKAPKRLIYAALRMQSGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 906 - protein, 448 aa, Artificial Sequence
  Synthetic Polypeptide
QVQLVQSGAEVKKPGASVKVSCKASGYTFTSTYIYWVRQAPGQGLEWMGWINPNAGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 907 - protein, 214 aa, Artificial Sequence; identical to SEQ ID NO: 905
  Synthetic Polypeptide

SEQ ID NO: 908 - protein, 448 aa, Artificial Sequence
  Synthetic Polypeptide
QVQLVQSGAEVKKPGASVKVSCKASGYTFTDYYIYWVRQAPGQGLEWMGWINPFKMGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 909 - protein, 214 aa, Artificial Sequence; identical to SEQ ID NO: 905
  Synthetic Polypeptide

SEQ ID NO: 910 - protein, 448 aa, Artificial Sequence
  Synthetic Polypeptide
QVQLVQSGAEVKKPGASVKVSCKASGYTFTDYYIYWVRQAPGQGLEWMGWINPTEDGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 911 - protein, 214 aa, Artificial Sequence; identical to SEQ ID NO: 905
  Synthetic Polypeptide

SEQ ID NO: 912 - protein, 448 aa, Artificial Sequence
  Synthetic Polypeptide
QVQLVQSGAEVKKPGASVKVSCKASGYTFTDYYIYWVRQAPGQGLEWMGWINPNAGPYMYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 913 - protein, 214 aa, Artificial Sequence; identical to SEQ ID NO: 895
  Synthetic Polypeptide

SEQ ID NO: 914 - protein, 448 aa, Artificial Sequence
  Synthetic Polypeptide
QVQLVQSGAEVKKPGASVKVSCKASGYTFTSDFIYWVRQAPGQGLEWMGWINPNAGGTNYAQKFQGRVTMTRDTSISTAYIELSRLRSDDTAVYYCAREDNFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 915 - protein, 214 aa, Artificial Sequence; identical to SEQ ID NO: 895
  Synthetic Polypeptide

SEQ ID NO: 916 - protein, 448 aa, Artificial Sequence; identical to SEQ ID NO: 906
  Synthetic Polypeptide

SEQ ID NO: 917 - protein, 214 aa, Artificial Sequence; identical to SEQ ID NO: 895
  Synthetic Polypeptide

SEQ ID NO: 918 - protein, 448 aa, Artificial Sequence; identical to SEQ ID NO: 908
  Synthetic Polypeptide

SEQ ID NO: 919 - protein, 214 aa, Artificial Sequence; identical to SEQ ID NO: 895
  Synthetic Polypeptide

SEQ ID NO: 920 - protein, 448 aa, Artificial Sequence; identical to SEQ ID NO: 910
  Synthetic Polypeptide

SEQ ID NO: 921 - protein, 214 aa, Artificial Sequence; identical to SEQ ID NO: 895
  Synthetic Polypeptide

SEQ ID NO: 922 - protein, 448 aa, Artificial Sequence; identical to SEQ ID NO: 912
  Synthetic Polypeptide

SEQ ID NO: 923 - protein, 214 aa, Artificial Sequence
  Synthetic Polypeptide
DIQMTQSPSSLSASVGDRVTITCRASRGIRNDLGWYQQKPGKAPKRLIYAAKLTQSGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 924 - protein, 448 aa, Artificial Sequence; identical to SEQ ID NO: 914
  Synthetic Polypeptide

SEQ ID NO: 925 - protein, 214 aa, Artificial Sequence; identical to SEQ ID NO: 923
  Synthetic Polypeptide

SEQ ID NO: 926 - protein, 448 aa, Artificial Sequence; identical to SEQ ID NO: 906
  Synthetic Polypeptide

SEQ ID NO: 927 - protein, 214 aa, Artificial Sequence; identical to SEQ ID NO: 923
  Synthetic Polypeptide

SEQ ID NO: 928 - protein, 448 aa, Artificial Sequence; identical to SEQ ID NO: 908
  Synthetic Polypeptide

SEQ ID NO: 929 - protein, 214 aa, Artificial Sequence; identical to SEQ ID NO: 923
  Synthetic Polypeptide

SEQ ID NO: 930 - protein, 448 aa, Artificial Sequence; identical to SEQ ID NO: 910
  Synthetic Polypeptide

SEQ ID NO: 931 - protein, 214 aa, Artificial Sequence; identical to SEQ ID NO: 923
  Synthetic Polypeptide

SEQ ID NO: 932 - protein, 448 aa, Artificial Sequence; identical to SEQ ID NO: 912
  Synthetic Polypeptide

SEQ ID NO: 933 - protein, 214 aa, Artificial Sequence; identical to SEQ ID NO: 20
  Synthetic Polypeptide

SEQ ID NO: 934 - protein, 448 aa, Artificial Sequence; identical to SEQ ID NO: 914
  Synthetic Polypeptide

SEQ ID NO: 935 - protein, 214 aa, Artificial Sequence
  Synthetic Polypeptide
DIQMTQSPSSLSASVGDRVTITCRSAYGIRNDLGWYQQKPGKAPKRLIYAALRMQSGVPSRFSGSGSGTEFTLTISSLQPEDFATYYCLQLNAYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 936 - protein, 448 aa, Artificial Sequence; identical to SEQ ID NO: 19
  Synthetic Polypeptide

SEQ ID NO: 937 - protein, 214 aa, Artificial Sequence
  Synthetic Polypeptide
EIVMTQSPATLSLSPGERATLSCRSSQSISSYLNWYQQKPGQAPRLLIHAASSLQSGIPARFSGSGSGTDFTLTISSLQPEDFAVYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 938 - protein, 450 aa, Artificial Sequence
  Synthetic Polypeptide
QVQLVESGGGLVKPGGSLRLSCAVSGGSISSGGYYWSWIRQAPGKGLEWVSYIYYRGGTYYNPSVKGRFTMSVDTSKNSFYLQMNSLRAEDTAVYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 939 - protein, 214 aa, Artificial Sequence; identical to SEQ ID NO: 639
  Synthetic Polypeptide

SEQ ID NO: 940 - protein, 450 aa, Artificial Sequence; identical to SEQ ID NO: 938
  Synthetic Polypeptide

SEQ ID NO: 941 - protein, 214 aa, Artificial Sequence; identical to SEQ ID NO: 639
  Synthetic Polypeptide

SEQ ID NO: 942 - protein, 450 aa, Artificial Sequence
  Synthetic Polypeptide
QVQLVQSGAEVKKPGASVKVSCKVSGGSISSGGYYWSWIRQAPGQGLEWMGYIYYRGGTYYNPKFQGRVTMTVDTSKNTFYMELSSLRSEDTAVYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 943 - protein, 214 aa, Artificial Sequence; identical to SEQ ID NO: 937
  Synthetic Polypeptide

SEQ ID NO: 944 - protein, 450 aa, Artificial Sequence; identical to SEQ ID NO: 642
  Synthetic Polypeptide

SEQ ID NO: 945 - protein, 214 aa, Artificial Sequence; identical to SEQ ID NO: 200
  Synthetic Polypeptide

SEQ ID NO: 946 - protein, 450 aa, Artificial Sequence
  Synthetic Polypeptide
QVQLQESGPGLVKPSETLSLTCTVSGGSISSGPYHWSWIRQHPGKGLEWIGYIYYRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 947 - protein, 214 aa, Artificial Sequence; identical to SEQ ID NO: 200
  Synthetic Polypeptide

SEQ ID NO: 948 - protein, 450 aa, Artificial Sequence
  Synthetic Polypeptide
QVQLQESGPGLVKPSETLSLTCTVSGGSISSGPYYWSWIRQHPGKGLEWIGYIYYRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 949 - protein, 214 aa, Artificial Sequence; identical to SEQ ID NO: 200
  Synthetic Polypeptide

SEQ ID NO: 950 - protein, 450 aa, Artificial Sequence
  Synthetic Polypeptide
QVQLQESGPGLVKPSETLSLTCTVSGGSISSGGYHWSWIRQHPGKGLEWIGYIYYRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 951 - protein, 214 aa, Artificial Sequence
  Synthetic Polypeptide
DIQMTQSPSSLSASVGDRVTITCRSSQSISQYLNWYQQKPGRAPKLLIYYASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 952 - protein, 450 aa, Artificial Sequence; identical to SEQ ID NO: 946
  Synthetic Polypeptide

SEQ ID NO: 953 - protein, 214 aa, Artificial Sequence
  Synthetic Polypeptide
DIQMTQSPSSLSASVGDRVTITCRSSQSISTYLNWYQQKPGRAPKLLIYAASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 954 - protein, 450 aa, Artificial Sequence
  Synthetic Polypeptide
QVQLQESGPGLVKPSETLSLTCTVSGGSISSGPYHWSWIRQHPGKGLEWIGYIYFRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 955 - protein, 214 aa, Artificial Sequence
  Synthetic Polypeptide
DIQMTQSPSSLSASVGDRVTITCRSSQSISLYLNWYQQKPGRAPKLLIYSASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 956 - protein, 450 aa, Artificial Sequence; identical to SEQ ID NO: 946
  Synthetic Polypeptide

SEQ ID NO: 957 - protein, 214 aa, Artificial Sequence
  Synthetic Polypeptide
DIQMTQSPSSLSASVGDRVTITCRSSQSISSYLNWYQQKPGRAPKLLIYGASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 958 - protein, 450 aa, Artificial Sequence; identical to SEQ ID NO: 946
  Synthetic Polypeptide

SEQ ID NO: 959 - protein, 214 aa, Artificial Sequence
  Synthetic Polypeptide
DIQMTQSPSSLSASVGDRVTITCRSSQSIKKYLNWYQQKPGRAPKLLIYAASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 960 - protein, 450 aa, Artificial Sequence; identical to SEQ ID NO: 948
  Synthetic Polypeptide

SEQ ID NO: 961 - protein, 214 aa, Artificial Sequence
  Synthetic Polypeptide
DIQMTQSPSSLSASVGDRVTITCRSSQSISSYLNWYQQKPGRAPKLLIYAASSLQSGVPSRFSGSGSGTDFTLTISSLQPEDFASYYCQQSYTTPPSFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 962 - protein, 450 aa, Artificial Sequence; identical to SEQ ID NO: 948
  Synthetic Polypeptide

SEQ ID NO: 963 - protein, 214 aa, Artificial Sequence
  Synthetic Polypeptide
DIQMTQSPSSLSASVGDRVTITCVSSQSISSYLNWYQQKPGRAPKLLIYAASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 964 - protein, 450 aa, Artificial Sequence; identical to SEQ ID NO: 946
  Synthetic Polypeptide

SEQ ID NO: 965 - protein, 214 aa, Artificial Sequence
  Synthetic Polypeptide
DIQMTQSPSSLSASVGDRVTITCRSSQSISAYLNWYQQKPGRAPKLLIYAASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 966 - protein, 450 aa, Artificial Sequence
  Synthetic Polypeptide
QVQLQESGPGLVKPSETLSLTCTVSGGSISSGPYYWSWIRQHPGKGLEWIGYIYFRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 967 - protein, 214 aa, Artificial Sequence
  Synthetic Polypeptide
DIQMTQSPSSLSASVGDRVTITCRSSQSISSYLNWYQQKPGRAPKLLIYAASSLQSGVPSRFSGSGSGTDFTLTISSLQPEDFASYYCQQSYTTPPGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 968 - protein, 450 aa, Artificial Sequence; identical to SEQ ID NO: 948
  Synthetic Polypeptide

SEQ ID NO: 969 - protein, 214 aa, Artificial Sequence
  Synthetic Polypeptide
DIQMTQSPSSLSASVGDRVTITCRSSQHIRSYLNWYQQKPGRAPKLLIYAASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 970 - protein, 450 aa, Artificial Sequence; identical to SEQ ID NO: 948
  Synthetic Polypeptide

SEQ ID NO: 971 - protein, 214 aa, Artificial Sequence
  Synthetic Polypeptide
DIQMTQSPSSLSASVGDRVTITCRSSQSISSYLNWYQQKPGRAPKLLIYAAQSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 972 - protein, 450 aa, Artificial Sequence; identical to SEQ ID NO: 948
  Synthetic Polypeptide

SEQ ID NO: 973 - protein, 214 aa, Artificial Sequence
  Synthetic Polypeptide
DIQMTQSPSSLSASVGDRVTITCRSSQSIKSYLNWYQQKPGRAPKLLIYAASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 974 - protein, 450 aa, Artificial Sequence; identical to SEQ ID NO: 948
  Synthetic Polypeptide

SEQ ID NO: 975 - protein, 214 aa, Artificial Sequence
  Synthetic Polypeptide
DIQMTQSPSSLSASVGDRVTITCRSSQAIRSYLNWYQQKPGRAPKLLIYAASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 976 - protein, 450 aa, Artificial Sequence; identical to SEQ ID NO: 948
  Synthetic Polypeptide

SEQ ID NO: 977 - protein, 214 aa, Artificial Sequence
  Synthetic Polypeptide
DIQMTQSPSSLSASVGDRVTITCRSSQSISGYLNWYQQKPGRAPKLLIYYASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 978 - protein, 450 aa, Artificial Sequence; identical to SEQ ID NO: 948
  Synthetic Polypeptide

SEQ ID NO: 979 - protein, 214 aa, Artificial Sequence
  Synthetic Polypeptide
DIQMTQSPSSLSASVGDRVTITCRSSQSISSYLNWYQQKPGRAPKLLIYAASSSPSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 980 - protein, 450 aa, Artificial Sequence; identical to SEQ ID NO: 948
  Synthetic Polypeptide

SEQ ID NO: 981 - protein, 214 aa, Artificial Sequence
  Synthetic Polypeptide
DIQMTQSPSSLSASVGDRVTITCRSSQSISSYLNWYQQKPGRAPKLLIYAAERLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 982 - protein, 450 aa, Artificial Sequence; identical to SEQ ID NO: 946
  Synthetic Polypeptide

SEQ ID NO: 983 - protein, 214 aa, Artificial Sequence
  Synthetic Polypeptide
DIQMTQSPSSLSASVGDRVTITCRSSQSISSYLNWYQQKPGRAPKLLIYAASSKSSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 984 - protein, 450 aa, Artificial Sequence; identical to SEQ ID NO: 946
  Synthetic Polypeptide

SEQ ID NO: 985 - protein, 214 aa, Artificial Sequence
  Synthetic Polypeptide
DIQMTQSPSSLSASVGDRVTITCRSSQSISSYLNWYQQKPGRAPKLLIYAASSLLLGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 986 - protein, 450 aa, Artificial Sequence; identical to SEQ ID NO: 946
  Synthetic Polypeptide

SEQ ID NO: 987 - protein, 214 aa, Artificial Sequence
  Synthetic Polypeptide
DIQMTQSPSSLSASVGDRVTITCRSSQSISHYLNWYQQKPGRAPKLLIYAATSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 988 - protein, 450 aa, Artificial Sequence; identical to SEQ ID NO: 946
  Synthetic Polypeptide

SEQ ID NO: 989 - protein, 214 aa, Artificial Sequence
  Synthetic Polypeptide
DIQMTQSPSSLSASVGDRVTITCRSSQQISSYLNWYQQKPGRAPKLLIYAASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 990 - protein, 450 aa, Artificial Sequence; identical to SEQ ID NO: 946
  Synthetic Polypeptide

SEQ ID NO: 991 - protein, 214 aa, Artificial Sequence
  Synthetic Polypeptide
DIQMTQSPSSLSASVGDRVTITCRSSQSISSYLNWYQQKPGRAPKLLIYAASSPGSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 992 - protein, 450 aa, Artificial Sequence; identical to SEQ ID NO: 946
  Synthetic Polypeptide

SEQ ID NO: 993 - protein, 214 aa, Artificial Sequence; identical to SEQ ID NO: 200
  Synthetic Polypeptide

SEQ ID NO: 994 - protein, 450 aa, Artificial Sequence
  Synthetic Polypeptide
QVQLQESGPGLVKPSETLSLTCTVSGGSISSGPYHWSWIRQHPGKGLEWIGYIYHRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 995 - protein, 214 aa, Artificial Sequence; identical to SEQ ID NO: 200
  Synthetic Polypeptide

SEQ ID NO: 996 - protein, 450 aa, Artificial Sequence
  Synthetic Polypeptide
QVQLQESGPGLVKPSETLSLTCTVSGGSISSGPYYWSWIRQHPGKGLEWIGYIYHRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 997 - protein, 214 aa, Artificial Sequence; identical to SEQ ID NO: 200
  Synthetic Polypeptide

SEQ ID NO: 998 - protein, 450 aa, Artificial Sequence
  Synthetic Polypeptide
QVQLQESGPGLVKPSETLSLTCTVSGGSISSGGYHWSWIRQHPGKGLEWIGYIYHRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 999 - protein, 214 aa, Artificial Sequence; identical to SEQ ID NO: 951
  Synthetic Polypeptide

SEQ ID NO: 1000 - protein, 450 aa, Artificial Sequence; identical to SEQ ID NO: 994
  Synthetic Polypeptide

SEQ ID NO: 1001 - protein, 214 aa, Artificial Sequence; identical to SEQ ID NO: 953
  Synthetic Polypeptide

SEQ ID NO: 1002 - protein, 450 aa, Artificial Sequence; identical to SEQ ID NO: 994
  Synthetic Polypeptide

SEQ ID NO: 1003 - protein, 214 aa, Artificial Sequence; identical to SEQ ID NO: 955
  Synthetic Polypeptide

SEQ ID NO: 1004 - protein, 450 aa, Artificial Sequence; identical to SEQ ID NO: 994
  Synthetic Polypeptide

SEQ ID NO: 1005 - protein, 214 aa, Artificial Sequence; identical to SEQ ID NO: 957
  Synthetic Polypeptide

SEQ ID NO: 1006 - protein, 450 aa, Artificial Sequence; identical to SEQ ID NO: 994
  Synthetic Polypeptide

SEQ ID NO: 1007 - protein, 214 aa, Artificial Sequence; identical to SEQ ID NO: 959
  Synthetic Polypeptide

SEQ ID NO: 1008 - protein, 450 aa, Artificial Sequence; identical to SEQ ID NO: 996
  Synthetic Polypeptide

SEQ ID NO: 1009 - protein, 214 aa, Artificial Sequence; identical to SEQ ID NO: 961
  Synthetic Polypeptide

SEQ ID NO: 1010 - protein, 450 aa, Artificial Sequence; identical to SEQ ID NO: 996
  Synthetic Polypeptide

SEQ ID NO: 1011 - protein, 214 aa, Artificial Sequence; identical to SEQ ID NO: 963
  Synthetic Polypeptide

SEQ ID NO: 1012 - protein, 450 aa, Artificial Sequence; identical to SEQ ID NO: 994
  Synthetic Polypeptide

SEQ ID NO: 1013 - protein, 214 aa, Artificial Sequence; identical to SEQ ID NO: 200
  Synthetic Polypeptide

SEQ ID NO: 1014 - protein, 450 aa, Artificial Sequence
  Synthetic Polypeptide
QVQLQESGPGLVKPSETLSLTCTVSGGSISSGPYHWSWIRQHPGKGLEWIGYIYQRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1015 - protein, 214 aa, Artificial Sequence; identical to SEQ ID NO: 200
  Synthetic Polypeptide

SEQ ID NO: 1016 - protein, 450 aa, Artificial Sequence
  Synthetic Polypeptide
QVQLQESGPGLVKPSETLSLTCTVSGGSISSGPYYWSWIRQHPGKGLEWIGYIYQRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1017 - protein, 214 aa, Artificial Sequence; identical to SEQ ID NO: 200
  Synthetic Polypeptide

SEQ ID NO: 1018 - protein, 450 aa, Artificial Sequence
  Synthetic Polypeptide
QVQLQESGPGLVKPSETLSLTCTVSGGSISSGGYHWSWIRQHPGKGLEWIGYIYQRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1019 - protein, 214 aa, Artificial Sequence; identical to SEQ ID NO: 951
  Synthetic Polypeptide

SEQ ID NO: 1020 - protein, 450 aa, Artificial Sequence; identical to SEQ ID NO: 1014
  Synthetic Polypeptide

SEQ ID NO: 1021 - protein, 214 aa, Artificial Sequence; identical to SEQ ID NO: 953
  Synthetic Polypeptide

SEQ ID NO: 1022 - protein, 450 aa, Artificial Sequence; identical to SEQ ID NO: 1014
  Synthetic Polypeptide

SEQ ID NO: 1023 - protein, 214 aa, Artificial Sequence; identical to SEQ ID NO: 955
  Synthetic Polypeptide

SEQ ID NO: 1024 - protein, 450 aa, Artificial Sequence; identical to SEQ ID NO: 1014
  Synthetic Polypeptide

SEQ ID NO: 1025 - protein, 214 aa, Artificial Sequence; identical to SEQ ID NO: 957
  Synthetic Polypeptide

SEQ ID NO: 1026 - protein, 450 aa, Artificial Sequence; identical to SEQ ID NO: 1014
  Synthetic Polypeptide

SEQ ID NO: 1027 - protein, 214 aa, Artificial Sequence; identical to SEQ ID NO: 959
  Synthetic Polypeptide

SEQ ID NO: 1028 - protein, 450 aa, Artificial Sequence; identical to SEQ ID NO: 1016
  Synthetic Polypeptide

SEQ ID NO: 1029 - protein, 214 aa, Artificial Sequence; identical to SEQ ID NO: 961
  Synthetic Polypeptide

SEQ ID NO: 1030 - protein, 450 aa, Artificial Sequence; identical to SEQ ID NO: 1016
  Synthetic Polypeptide

SEQ ID NO: 1031 - protein, 214 aa, Artificial Sequence; identical to SEQ ID NO: 963
  Synthetic Polypeptide

SEQ ID NO: 1032 - protein, 450 aa, Artificial Sequence; identical to SEQ ID NO: 1014
  Synthetic Polypeptide

SEQ ID NO: 1033 - protein, 214 aa, Artificial Sequence; identical to SEQ ID NO: 200
  Synthetic Polypeptide

SEQ ID NO: 1034 - protein, 450 aa, Artificial Sequence
  Synthetic Polypeptide
QVQLQESGPGLVKPSETLSLTCTVSGGSISSGPYHWSWIRQHPGKGLEWIGYIYYRGGTYYNPSLRSRVTMSVDTSKNQFSLRLSSVTAADTAVYYCARTIFGPVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1035 - protein, 214 aa, Artificial Sequence; identical to SEQ ID NO: 200
  Synthetic Polypeptide

SEQ ID NO: 1036 - protein, 450 aa, Artificial Sequence
  Synthetic Polypeptide
QVQLQESGPGLVKPSETLSLTCTVSGGSISSGPYYWSWIRQHPGKGLEWIGYIYYRGGTYYNPSLRSRVTMSVDTSKNQFSLRLSSVTAADTAVYYCARTIFGPVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1037 - protein, 214 aa, Artificial Sequence; identical to SEQ ID NO: 200
  Synthetic Polypeptide

SEQ ID NO: 1038 - protein, 450 aa, Artificial Sequence
  Synthetic Polypeptide
QVQLQESGPGLVKPSETLSLTCTVSGGSISSGGYHWSWIRQHPGKGLEWIGYIYYRGGTYYNPSLRSRVTMSVDTSKNQFSLRLSSVTAADTAVYYCARTIFGPVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1039 - protein, 214 aa, Artificial Sequence; identical to SEQ ID NO: 951
  Synthetic Polypeptide

SEQ ID NO: 1040 - protein, 450 aa, Artificial Sequence; identical to SEQ ID NO: 1034
  Synthetic Polypeptide

SEQ ID NO: 1041 - protein, 214 aa, Artificial Sequence; identical to SEQ ID NO: 953
  Synthetic Polypeptide

SEQ ID NO: 1042 - protein, 450 aa, Artificial Sequence
  Synthetic Polypeptide
QVQLQESGPGLVKPSETLSLTCTVSGGSISSGPYHWSWIRQHPGKGLEWIGYIYFRGGTYYNPSLRSRVTMSVDTSKNQFSLRLSSVTAADTAVYYCARTIFGPVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1043 - protein, 214 aa, Artificial Sequence; identical to SEQ ID NO: 955
  Synthetic Polypeptide

SEQ ID NO: 1044 - protein, 450 aa, Artificial Sequence; identical to SEQ ID NO: 1034
  Synthetic Polypeptide

SEQ ID NO: 1045 - protein, 214 aa, Artificial Sequence; identical to SEQ ID NO: 957
  Synthetic Polypeptide

SEQ ID NO: 1046 - protein, 450 aa, Artificial Sequence; identical to SEQ ID NO: 1034
  Synthetic Polypeptide

SEQ ID NO: 1047 - protein, 214 aa, Artificial Sequence; identical to SEQ ID NO: 959
  Synthetic Polypeptide

SEQ ID NO: 1048 - protein, 450 aa, Artificial Sequence; identical to SEQ ID NO: 1036
  Synthetic Polypeptide

SEQ ID NO: 1049 - protein, 214 aa, Artificial Sequence; identical to SEQ ID NO: 961
  Synthetic Polypeptide

SEQ ID NO: 1050 - protein, 450 aa, Artificial Sequence; identical to SEQ ID NO: 1036
  Synthetic Polypeptide

SEQ ID NO: 1051 - protein, 214 aa, Artificial Sequence; identical to SEQ ID NO: 963
  Synthetic Polypeptide

SEQ ID NO: 1052 - protein, 450 aa, Artificial Sequence; identical to SEQ ID NO: 1034
  Synthetic Polypeptide

SEQ ID NO: 1053 - protein, 214 aa, Artificial Sequence; identical to SEQ ID NO: 200
  Synthetic Polypeptide

SEQ ID NO: 1054 - protein, 450 aa, Artificial Sequence
  Synthetic Polypeptide
QVQLQESGPGLVKPSETLSLTCTVSGGSISSGPYHWSWIRQHPGKGLEWIGYIYYRGGTYYNPSLRSRVTMSVDTSKNQFSLRLSSVTAADTAVYYCARTIFGAVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1055 - protein, 214 aa, Artificial Sequence; identical to SEQ ID NO: 200
  Synthetic Polypeptide

SEQ ID NO: 1056 - protein, 450 aa, Artificial Sequence
  Synthetic Polypeptide
QVQLQESGPGLVKPSETLSLTCTVSGGSISSGPYYWSWIRQHPGKGLEWIGYIYYRGGTYYNPSLRSRVTMSVDTSKNQFSLRLSSVTAADTAVYYCARTIFGAVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1057 - protein, 214 aa, Artificial Sequence; identical to SEQ ID NO: 200
  Synthetic Polypeptide

SEQ ID NO: 1058 - protein, 450 aa, Artificial Sequence
  Synthetic Polypeptide
QVQLQESGPGLVKPSETLSLTCTVSGGSISSGGYHWSWIRQHPGKGLEWIGYIYYRGGTYYNPSLRSRVTMSVDTSKNQFSLRLSSVTAADTAVYYCARTIFGAVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1059 - protein, 214 aa, Artificial Sequence; identical to SEQ ID NO: 951
  Synthetic Polypeptide

SEQ ID NO: 1060 - protein, 450 aa, Artificial Sequence; identical to SEQ ID NO: 1054
  Synthetic Polypeptide

SEQ ID NO: 1061 - protein, 214 aa, Artificial Sequence; identical to SEQ ID NO: 953
  Synthetic Polypeptide

SEQ ID NO: 1062 - protein, 450 aa, Artificial Sequence
  Synthetic Polypeptide
QVQLQESGPGLVKPSETLSLTCTVSGGSISSGPYHWSWIRQHPGKGLEWIGYIYFRGGTYYNPSLRSRVTMSVDTSKNQFSLRLSSVTAADTAVYYCARTIFGAVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1063 - protein, 214 aa, Artificial Sequence; identical to SEQ ID NO: 955
  Synthetic Polypeptide

SEQ ID NO: 1064 - protein, 450 aa, Artificial Sequence; identical to SEQ ID NO: 1054
  Synthetic Polypeptide

SEQ ID NO: 1065 - protein, 214 aa, Artificial Sequence; identical to SEQ ID NO: 957
  Synthetic Polypeptide

SEQ ID NO: 1066 - protein, 450 aa, Artificial Sequence; identical to SEQ ID NO: 1054
  Synthetic Polypeptide

SEQ ID NO: 1067 - protein, 214 aa, Artificial Sequence; identical to SEQ ID NO: 959
  Synthetic Polypeptide

SEQ ID NO: 1068 - protein, 450 aa, Artificial Sequence; identical to SEQ ID NO: 1056
  Synthetic Polypeptide

SEQ ID NO: 1069 - protein, 214 aa, Artificial Sequence; identical to SEQ ID NO: 961
  Synthetic Polypeptide

SEQ ID NO: 1070 - protein, 450 aa, Artificial Sequence; identical to SEQ ID NO: 1056
  Synthetic Polypeptide

SEQ ID NO: 1071 - protein, 214 aa, Artificial Sequence; identical to SEQ ID NO: 963
  Synthetic Polypeptide

SEQ ID NO: 1072 - protein, 450 aa, Artificial Sequence; identical to SEQ ID NO: 1054
  Synthetic Polypeptide

SEQ ID NO: 1073 - protein, 214 aa, Artificial Sequence; identical to SEQ ID NO: 200
  Synthetic Polypeptide

SEQ ID NO: 1074 - protein, 450 aa, Artificial Sequence
  Synthetic Polypeptide
QVQLQESGPGLVKPSETLSLTCTVSGGSISSGPYHWSWIRQHPGKGLEWIGYIYYRGGTYYNPSLRSRVTMSVDTSKNQFSLRLSSVTAADTAVYYCARTIFGAIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1075 - protein, 214 aa, Artificial Sequence; identical to SEQ ID NO: 200
  Synthetic Polypeptide

SEQ ID NO: 1076 - protein, 450 aa, Artificial Sequence
  Synthetic Polypeptide
QVQLQESGPGLVKPSETLSLTCTVSGGSISSGPYYWSWIRQHPGKGLEWIGYIYYRGGTYYNPSLRSRVTMSVDTSKNQFSLRLSSVTAADTAVYYCARTIFGAIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1077 - protein, 214 aa, Artificial Sequence; identical to SEQ ID NO: 200
  Synthetic Polypeptide

SEQ ID NO: 1078 - protein, 450 aa, Artificial Sequence
  Synthetic Polypeptide
QVQLQESGPGLVKPSETLSLTCTVSGGSISSGGYHWSWIRQHPGKGLEWIGYIYYRGGTYYNPSLRSRVTMSVDTSKNQFSLRLSSVTAADTAVYYCARTIFGAIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1079 - protein, 214 aa, Artificial Sequence; identical to SEQ ID NO: 951
  Synthetic Polypeptide

SEQ ID NO: 1080 - protein, 450 aa, Artificial Sequence; identical to SEQ ID NO: 1074
  Synthetic Polypeptide

SEQ ID NO: 1081 - protein, 214 aa, Artificial Sequence; identical to SEQ ID NO: 953
  Synthetic Polypeptide

SEQ ID NO: 1082 - protein, 450 aa, Artificial Sequence
  Synthetic Polypeptide
QVQLQESGPGLVKPSETLSLTCTVSGGSISSGPYHWSWIRQHPGKGLEWIGYIYFRGGTYYNPSLRSRVTMSVDTSKNQFSLRLSSVTAADTAVYYCARTIFGAIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1083 - protein, 214 aa, Artificial Sequence; identical to SEQ ID NO: 955
  Synthetic Polypeptide

SEQ ID NO: 1084 - protein, 450 aa, Artificial Sequence; identical to SEQ ID NO: 1074
  Synthetic Polypeptide

SEQ ID NO: 1085 - protein, 214 aa, Artificial Sequence; identical to SEQ ID NO: 957
  Synthetic Polypeptide

SEQ ID NO: 1086 - protein, 450 aa, Artificial Sequence; identical to SEQ ID NO: 1074
  Synthetic Polypeptide

SEQ ID NO: 1087 - protein, 214 aa, Artificial Sequence; identical to SEQ ID NO: 959
  Synthetic Polypeptide

SEQ ID NO: 1088 - protein, 450 aa, Artificial Sequence; identical to SEQ ID NO: 1076
  Synthetic Polypeptide

SEQ ID NO: 1089 - protein, 214 aa, Artificial Sequence; identical to SEQ ID NO: 961
  Synthetic Polypeptide

SEQ ID NO: 1090 - protein, 450 aa, Artificial Sequence; identical to SEQ ID NO: 1076
  Synthetic Polypeptide

SEQ ID NO: 1091 - protein, 214 aa, Artificial Sequence; identical to SEQ ID NO: 963
  Synthetic Polypeptide

SEQ ID NO: 1092 - protein, 450 aa, Artificial Sequence; identical to SEQ ID NO: 1074
  Synthetic Polypeptide

SEQ ID NO: 1093 - protein, 214 aa, Artificial Sequence; identical to SEQ ID NO: 200
  Synthetic Polypeptide

SEQ ID NO: 1094 - protein, 450 aa, Artificial Sequence
  Synthetic Polypeptide
QVQLQESGPGLVKPSETLSLTCTVSGGSISSGPYHWSWIRQHPGKGLEWIGYIYHRGGTYYNPSLRSRVTMSVDTSKNQFSLRLSSVTAADTAVYYCARTIFGPVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1095 - protein, 214 aa, Artificial Sequence; identical to SEQ ID NO: 200
  Synthetic Polypeptide

SEQ ID NO: 1096 - protein, 450 aa, Artificial Sequence
  Synthetic Polypeptide
QVQLQESGPGLVKPSETLSLTCTVSGGSISSGPYYWSWIRQHPGKGLEWIGYIYHRGGTYYNPSLRSRVTMSVDTSKNQFSLRLSSVTAADTAVYYCARTIFGPVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1097 - protein, 214 aa, Artificial Sequence; identical to SEQ ID NO: 200
  Synthetic Polypeptide

SEQ ID NO: 1098 - protein, 450 aa, Artificial Sequence
  Synthetic Polypeptide
QVQLQESGPGLVKPSETLSLTCTVSGGSISSGGYHWSWIRQHPGKGLEWIGYIYHRGGTYYNPSLRSRVTMSVDTSKNQFSLRLSSVTAADTAVYYCARTIFGPVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1099 - protein, 214 aa, Artificial Sequence; identical to SEQ ID NO: 951
  Synthetic Polypeptide

SEQ ID NO: 1100 - protein, 450 aa, Artificial Sequence; identical to SEQ ID NO: 1094
  Synthetic Polypeptide

SEQ ID NO: 1101 - protein, 214 aa, Artificial Sequence; identical to SEQ ID NO: 953
  Synthetic Polypeptide

SEQ ID NO: 1102 - protein, 450 aa, Artificial Sequence; identical to SEQ ID NO: 1094
  Synthetic Polypeptide

SEQ ID NO: 1103 - protein, 214 aa, Artificial Sequence; identical to SEQ ID NO: 955
  Synthetic Polypeptide

SEQ ID NO: 1104 - protein, 450 aa, Artificial Sequence; identical to SEQ ID NO: 1094
  Synthetic Polypeptide

SEQ ID NO: 1105 - protein, 214 aa, Artificial Sequence; identical to SEQ ID NO: 957
  Synthetic Polypeptide

SEQ ID NO: 1106 - protein, 450 aa, Artificial Sequence; identical to SEQ ID NO: 1094
  Synthetic Polypeptide

SEQ ID NO: 1107 - protein, 214 aa, Artificial Sequence; identical to SEQ ID NO: 959
  Synthetic Polypeptide

SEQ ID NO: 1108 - protein, 450 aa, Artificial Sequence; identical to SEQ ID NO: 1096
  Synthetic Polypeptide

SEQ ID NO: 1109 - protein, 214 aa, Artificial Sequence; identical to SEQ ID NO: 961
  Synthetic Polypeptide

SEQ ID NO: 1110 - protein, 450 aa, Artificial Sequence; identical to SEQ ID NO: 1096
  Synthetic Polypeptide

SEQ ID NO: 1111 - protein, 214 aa, Artificial Sequence; identical to SEQ ID NO: 963
  Synthetic Polypeptide

SEQ ID NO: 1112 - protein, 450 aa, Artificial Sequence; identical to SEQ ID NO: 1094
  Synthetic Polypeptide

SEQ ID NO: 1113 - protein, 214 aa, Artificial Sequence; identical to SEQ ID NO: 200
  Synthetic Polypeptide

SEQ ID NO: 1114 - protein, 450 aa, Artificial Sequence
  Synthetic Polypeptide
QVQLQESGPGLVKPSETLSLTCTVSGGSISSGPYHWSWIRQHPGKGLEWIGYIYHRGGTYYNPSLRSRVTMSVDTSKNQFSLRLSSVTAADTAVYYCARTIFGAVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1115 - protein, 214 aa, Artificial Sequence; identical to SEQ ID NO: 200
  Synthetic Polypeptide

SEQ ID NO: 1116 - protein, 450 aa, Artificial Sequence
  Synthetic Polypeptide
QVQLQESGPGLVKPSETLSLTCTVSGGSISSGPYYWSWIRQHPGKGLEWIGYIYHRGGTYYNPSLRSRVTMSVDTSKNQFSLRLSSVTAADTAVYYCARTIFGAVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1117 - protein, 214 aa, Artificial Sequence; identical to SEQ ID NO: 200
  Synthetic Polypeptide

SEQ ID NO: 1118 - protein, 450 aa, Artificial Sequence
  Synthetic Polypeptide
QVQLQESGPGLVKPSETLSLTCTVSGGSISSGGYHWSWIRQHPGKGLEWIGYIYHRGGTYYNPSLRSRVTMSVDTSKNQFSLRLSSVTAADTAVYYCARTIFGAVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1119 - protein, 214 aa, Artificial Sequence; identical to SEQ ID NO: 951
  Synthetic Polypeptide

SEQ ID NO: 1120 - protein, 450 aa, Artificial Sequence; identical to SEQ ID NO: 1114
  Synthetic Polypeptide

SEQ ID NO: 1121 - protein, 214 aa, Artificial Sequence; identical to SEQ ID NO: 953
  Synthetic Polypeptide

SEQ ID NO: 1122 - protein, 450 aa, Artificial Sequence; identical to SEQ ID NO: 1114
  Synthetic Polypeptide

SEQ ID NO: 1123 - protein, 214 aa, Artificial Sequence; identical to SEQ ID NO: 955
  Synthetic Polypeptide

SEQ ID NO: 1124 - protein, 450 aa, Artificial Sequence; identical to SEQ ID NO: 1114
  Synthetic Polypeptide

SEQ ID NO: 1125 - protein, 214 aa, Artificial Sequence; identical to SEQ ID NO: 957
  Synthetic Polypeptide

SEQ ID NO: 1126 - protein, 450 aa, Artificial Sequence; identical to SEQ ID NO: 1114
  Synthetic Polypeptide

SEQ ID NO: 1127 - protein, 214 aa, Artificial Sequence; identical to SEQ ID NO: 959
  Synthetic Polypeptide

SEQ ID NO: 1128 - protein, 450 aa, Artificial Sequence; identical to SEQ ID NO: 1116
  Synthetic Polypeptide

SEQ ID NO: 1129 - protein, 214 aa, Artificial Sequence; identical to SEQ ID NO: 961
  Synthetic Polypeptide

SEQ ID NO: 1130 - protein, 450 aa, Artificial Sequence; identical to SEQ ID NO: 1116
  Synthetic Polypeptide

SEQ ID NO: 1131 - protein, 214 aa, Artificial Sequence; identical to SEQ ID NO: 963
  Synthetic Polypeptide

SEQ ID NO: 1132 - protein, 450 aa, Artificial Sequence; identical to SEQ ID NO: 1114
  Synthetic Polypeptide

SEQ ID NO: 1133 - protein, 214 aa, Artificial Sequence; identical to SEQ ID NO: 200
  Synthetic Polypeptide

SEQ ID NO: 1134 - protein, 450 aa, Artificial Sequence
  Synthetic Polypeptide
QVQLQESGPGLVKPSETLSLTCTVSGGSISSGPYHWSWIRQHPGKGLEWIGYIYHRGGTYYNPSLRSRVTMSVDTSKNQFSLRLSSVTAADTAVYYCARTIFGAIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1135 - protein, 214 aa, Artificial Sequence; identical to SEQ ID NO: 200
  Synthetic Polypeptide

SEQ ID NO: 1136 - protein, 450 aa, Artificial Sequence
  Synthetic Polypeptide
QVQLQESGPGLVKPSETLSLTCTVSGGSISSGPYYWSWIRQHPGKGLEWIGYIYHRGGTYYNPSLRSRVTMSVDTSKNQFSLRLSSVTAADTAVYYCARTIFGAIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1137 - protein, 214 aa, Artificial Sequence; identical to SEQ ID NO: 200
  Synthetic Polypeptide

SEQ ID NO: 1138 - protein, 450 aa, Artificial Sequence
  Synthetic Polypeptide
QVQLQESGPGLVKPSETLSLTCTVSGGSISSGGYHWSWIRQHPGKGLEWIGYIYHRGGTYYNPSLRSRVTMSVDTSKNQFSLRLSSVTAADTAVYYCARTIFGAIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1139 - protein, 214 aa, Artificial Sequence; identical to SEQ ID NO: 951
  Synthetic Polypeptide

SEQ ID NO: 1140 - protein, 450 aa, Artificial Sequence; identical to SEQ ID NO: 1134
  Synthetic Polypeptide

SEQ ID NO: 1141 - protein, 214 aa, Artificial Sequence; identical to SEQ ID NO: 953
  Synthetic Polypeptide

SEQ ID NO: 1142 - protein, 450 aa, Artificial Sequence; identical to SEQ ID NO: 1134
  Synthetic Polypeptide

SEQ ID NO: 1143 - protein, 214 aa, Artificial Sequence; identical to SEQ ID NO: 955
  Synthetic Polypeptide

SEQ ID NO: 1144 - protein, 450 aa, Artificial Sequence; identical to SEQ ID NO: 1134
  Synthetic Polypeptide

SEQ ID NO: 1145 - protein, 214 aa, Artificial Sequence; identical to SEQ ID NO: 957
  Synthetic Polypeptide

SEQ ID NO: 1146 - protein, 450 aa, Artificial Sequence; identical to SEQ ID NO: 1134
  Synthetic Polypeptide

SEQ ID NO: 1147 - protein, 214 aa, Artificial Sequence; identical to SEQ ID NO: 959
  Synthetic Polypeptide

SEQ ID NO: 1148 - protein, 450 aa, Artificial Sequence; identical to SEQ ID NO: 1136
  Synthetic Polypeptide

SEQ ID NO: 1149 - protein, 214 aa, Artificial Sequence; identical to SEQ ID NO: 961
  Synthetic Polypeptide

SEQ ID NO: 1150 - protein, 450 aa, Artificial Sequence; identical to SEQ ID NO: 1136
  Synthetic Polypeptide

SEQ ID NO: 1151 - protein, 214 aa, Artificial Sequence; identical to SEQ ID NO: 963
  Synthetic Polypeptide

SEQ ID NO: 1152 - protein, 450 aa, Artificial Sequence; identical to SEQ ID NO: 1134
  Synthetic Polypeptide

SEQ ID NO: 1153 - protein, 214 aa, Artificial Sequence; identical to SEQ ID NO: 200
  Synthetic Polypeptide

SEQ ID NO: 1154 - protein, 450 aa, Artificial Sequence
  Synthetic Polypeptide
QVQLQESGPGLVKPSETLSLTCTVSGGSISSGPYHWSWIRQHPGKGLEWIGYIYQRGGTYYNPSLRSRVTMSVDTSKNQFSLRLSSVTAADTAVYYCARTIFGPVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1155 - protein, 214 aa, Artificial Sequence; identical to SEQ ID NO: 200
  Synthetic Polypeptide

SEQ ID NO: 1156 - protein, 450 aa, Artificial Sequence
  Synthetic Polypeptide
QVQLQESGPGLVKPSETLSLTCTVSGGSISSGPYYWSWIRQHPGKGLEWIGYIYQRGGTYYNPSLRSRVTMSVDTSKNQFSLRLSSVTAADTAVYYCARTIFGPVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1157 - protein, 214 aa, Artificial Sequence; identical to SEQ ID NO: 200
  Synthetic Polypeptide

SEQ ID NO: 1158 - protein, 450 aa, Artificial Sequence
  Synthetic Polypeptide
QVQLQESGPGLVKPSETLSLTCTVSGGSISSGGYHWSWIRQHPGKGLEWIGYIYQRGGTYYNPSLRSRVTMSVDTSKNQFSLRLSSVTAADTAVYYCARTIFGPVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1159 - protein, 214 aa, Artificial Sequence; identical to SEQ ID NO: 951
  Synthetic Polypeptide

SEQ ID NO: 1160 - protein, 450 aa, Artificial Sequence; identical to SEQ ID NO: 1154
  Synthetic Polypeptide

SEQ ID NO: 1161 - protein, 214 aa, Artificial Sequence; identical to SEQ ID NO: 953
  Synthetic Polypeptide

SEQ ID NO: 1162 - protein, 450 aa, Artificial Sequence; identical to SEQ ID NO: 1154
  Synthetic Polypeptide

SEQ ID NO: 1163 - protein, 214 aa, Artificial Sequence; identical to SEQ ID NO: 955
  Synthetic Polypeptide

SEQ ID NO: 1164 - protein, 450 aa, Artificial Sequence; identical to SEQ ID NO: 1154
  Synthetic Polypeptide

SEQ ID NO: 1165 - protein, 214 aa, Artificial Sequence; identical to SEQ ID NO: 957
  Synthetic Polypeptide

SEQ ID NO: 1166 - protein, 450 aa, Artificial Sequence; identical to SEQ ID NO: 1154
  Synthetic Polypeptide

SEQ ID NO: 1167 - protein, 214 aa, Artificial Sequence; identical to SEQ ID NO: 959
  Synthetic Polypeptide

SEQ ID NO: 1168 - protein, 450 aa, Artificial Sequence; identical to SEQ ID NO: 1156
  Synthetic Polypeptide

SEQ ID NO: 1169 - protein, 214 aa, Artificial Sequence; identical to SEQ ID NO: 961
  Synthetic Polypeptide

SEQ ID NO: 1170 - protein, 450 aa, Artificial Sequence; identical to SEQ ID NO: 1156
  Synthetic Polypeptide

SEQ ID NO: 1171 - protein, 214 aa, Artificial Sequence; identical to SEQ ID NO: 963
  Synthetic Polypeptide

SEQ ID NO: 1172 - protein, 450 aa, Artificial Sequence; identical to SEQ ID NO: 1154
  Synthetic Polypeptide

SEQ ID NO: 1173 - protein, 214 aa, Artificial Sequence; identical to SEQ ID NO: 200
  Synthetic Polypeptide

SEQ ID NO: 1174 - protein, 450 aa, Artificial Sequence
  Synthetic Polypeptide
QVQLQESGPGLVKPSETLSLTCTVSGGSISSGPYHWSWIRQHPGKGLEWIGYIYQRGGTYYNPSLRSRVTMSVDTSKNQFSLRLSSVTAADTAVYYCARTIFGAVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1175 - protein, 214 aa, Artificial Sequence; identical to SEQ ID NO: 200
  Synthetic Polypeptide

SEQ ID NO: 1176 - protein, 450 aa, Artificial Sequence
  Synthetic Polypeptide
QVQLQESGPGLVKPSETLSLTCTVSGGSISSGPYYWSWIRQHPGKGLEWIGYIYQRGGTYYNPSLRSRVTMSVDTSKNQFSLRLSSVTAADTAVYYCARTIFGAVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1177 - protein, 214 aa, Artificial Sequence; identical to SEQ ID NO: 200
  Synthetic Polypeptide

SEQ ID NO: 1178 - protein, 450 aa, Artificial Sequence
  Synthetic Polypeptide
QVQLQESGPGLVKPSETLSLTCTVSGGSISSGGYHWSWIRQHPGKGLEWIGYIYQRGGTYYNPSLRSRVTMSVDTSKNQFSLRLSSVTAADTAVYYCARTIFGAVILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1179 - protein, 214 aa, Artificial Sequence; identical to SEQ ID NO: 951
  Synthetic Polypeptide

SEQ ID NO: 1180 - protein, 450 aa, Artificial Sequence; identical to SEQ ID NO: 1174
  Synthetic Polypeptide

SEQ ID NO: 1181 - protein, 214 aa, Artificial Sequence; identical to SEQ ID NO: 953
  Synthetic Polypeptide

SEQ ID NO: 1182 - protein, 450 aa, Artificial Sequence; identical to SEQ ID NO: 1174
  Synthetic Polypeptide

SEQ ID NO: 1183 - protein, 214 aa, Artificial Sequence; identical to SEQ ID NO: 955
  Synthetic Polypeptide

SEQ ID NO: 1184 - protein, 450 aa, Artificial Sequence; identical to SEQ ID NO: 1174
  Synthetic Polypeptide

SEQ ID NO: 1185 - protein, 214 aa, Artificial Sequence; identical to SEQ ID NO: 957
  Synthetic Polypeptide

SEQ ID NO: 1186 - protein, 450 aa, Artificial Sequence; identical to SEQ ID NO: 1174
  Synthetic Polypeptide

SEQ ID NO: 1187 - protein, 214 aa, Artificial Sequence; identical to SEQ ID NO: 959
  Synthetic Polypeptide

SEQ ID NO: 1188 - protein, 450 aa, Artificial Sequence; identical to SEQ ID NO: 1176
  Synthetic Polypeptide

SEQ ID NO: 1189 - protein, 214 aa, Artificial Sequence; identical to SEQ ID NO: 961
  Synthetic Polypeptide

SEQ ID NO: 1190 - protein, 450 aa, Artificial Sequence; identical to SEQ ID NO: 1176
  Synthetic Polypeptide

SEQ ID NO: 1191 - protein, 214 aa, Artificial Sequence; identical to SEQ ID NO: 963
  Synthetic Polypeptide

SEQ ID NO: 1192 - protein, 450 aa, Artificial Sequence; identical to SEQ ID NO: 1174
  Synthetic Polypeptide

SEQ ID NO: 1193 - protein, 214 aa, Artificial Sequence; identical to SEQ ID NO: 200
  Synthetic Polypeptide

SEQ ID NO: 1194 - protein, 450 aa, Artificial Sequence
  Synthetic Polypeptide
QVQLQESGPGLVKPSETLSLTCTVSGGSISSGPYHWSWIRQHPGKGLEWIGYIYQRGGTYYNPSLRSRVTMSVDTSKNQFSLRLSSVTAADTAVYYCARTIFGAIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1195 - protein, 214 aa, Artificial Sequence; identical to SEQ ID NO: 200
  Synthetic Polypeptide

SEQ ID NO: 1196 - protein, 450 aa, Artificial Sequence
  Synthetic Polypeptide
QVQLQESGPGLVKPSETLSLTCTVSGGSISSGPYYWSWIRQHPGKGLEWIGYIYQRGGTYYNPSLRSRVTMSVDTSKNQFSLRLSSVTAADTAVYYCARTIFGAIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1197 - protein, 214 aa, Artificial Sequence; identical to SEQ ID NO: 200
  Synthetic Polypeptide

SEQ ID NO: 1198 - protein, 450 aa, Artificial Sequence
  Synthetic Polypeptide
QVQLQESGPGLVKPSETLSLTCTVSGGSISSGGYHWSWIRQHPGKGLEWIGYIYQRGGTYYNPSLRSRVTMSVDTSKNQFSLRLSSVTAADTAVYYCARTIFGAIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1199 - protein, 214 aa, Artificial Sequence; identical to SEQ ID NO: 951
  Synthetic Polypeptide

SEQ ID NO: 1200 - protein, 450 aa, Artificial Sequence; identical to SEQ ID NO: 1194
  Synthetic Polypeptide

SEQ ID NO: 1201 - protein, 214 aa, Artificial Sequence; identical to SEQ ID NO: 953
  Synthetic Polypeptide

SEQ ID NO: 1202 - protein, 450 aa, Artificial Sequence; identical to SEQ ID NO: 1194
  Synthetic Polypeptide

SEQ ID NO: 1203 - protein, 214 aa, Artificial Sequence; identical to SEQ ID NO: 955
  Synthetic Polypeptide

SEQ ID NO: 1204 - protein, 450 aa, Artificial Sequence; identical to SEQ ID NO: 1194
  Synthetic Polypeptide

SEQ ID NO: 1205 - protein, 214 aa, Artificial Sequence; identical to SEQ ID NO: 957
  Synthetic Polypeptide

SEQ ID NO: 1206 - protein, 450 aa, Artificial Sequence; identical to SEQ ID NO: 1194
  Synthetic Polypeptide

SEQ ID NO: 1207 - protein, 214 aa, Artificial Sequence; identical to SEQ ID NO: 959
  Synthetic Polypeptide

SEQ ID NO: 1208 - protein, 450 aa, Artificial Sequence; identical to SEQ ID NO: 1196
  Synthetic Polypeptide

SEQ ID NO: 1209 - protein, 214 aa, Artificial Sequence; identical to SEQ ID NO: 961
  Synthetic Polypeptide

SEQ ID NO: 1210 - protein, 450 aa, Artificial Sequence; identical to SEQ ID NO: 1196
  Synthetic Polypeptide

SEQ ID NO: 1211 - protein, 214 aa, Artificial Sequence; identical to SEQ ID NO: 963
  Synthetic Polypeptide

SEQ ID NO: 1212 - protein, 450 aa, Artificial Sequence; identical to SEQ ID NO: 1194
  Synthetic Polypeptide

SEQ ID NO: 1213 - protein, 214 aa, Artificial Sequence; identical to SEQ ID NO: 200
  Synthetic Polypeptide

SEQ ID NO: 1214 - protein, 450 aa, Artificial Sequence
  Synthetic Polypeptide
QVQLQESGPGLVKPSETLSLTCTVSGGSISSGPYHWSWIRQHPGKGLEWIGYIYYRGGTYYNPSLRSRVTMSVDTSKNQFSLRLSSVTAADTAVYYCARTIFGSIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1215 - protein, 214 aa, Artificial Sequence; identical to SEQ ID NO: 200
  Synthetic Polypeptide

SEQ ID NO: 1216 - protein, 450 aa, Artificial Sequence
  Synthetic Polypeptide
QVQLQESGPGLVKPSETLSLTCTVSGGSISSGPYYWSWIRQHPGKGLEWIGYIYYRGGTYYNPSLRSRVTMSVDTSKNQFSLRLSSVTAADTAVYYCARTIFGSIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1217 - protein, 214 aa, Artificial Sequence; identical to SEQ ID NO: 200
  Synthetic Polypeptide

SEQ ID NO: 1218 - protein, 450 aa, Artificial Sequence
  Synthetic Polypeptide
QVQLQESGPGLVKPSETLSLTCTVSGGSISSGGYHWSWIRQHPGKGLEWIGYIYYRGGTYYNPSLRSRVTMSVDTSKNQFSLRLSSVTAADTAVYYCARTIFGSIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1219 - protein, 214 aa, Artificial Sequence; identical to SEQ ID NO: 951
  Synthetic Polypeptide

SEQ ID NO: 1220 - protein, 450 aa, Artificial Sequence; identical to SEQ ID NO: 1214
  Synthetic Polypeptide

SEQ ID NO: 1221 - protein, 214 aa, Artificial Sequence; identical to SEQ ID NO: 953
  Synthetic Polypeptide

SEQ ID NO: 1222 - protein, 450 aa, Artificial Sequence
  Synthetic Polypeptide
QVQLQESGPGLVKPSETLSLTCTVSGGSISSGPYHWSWIRQHPGKGLEWIGYIYFRGGTYYNPSLRSRVTMSVDTSKNQFSLRLSSVTAADTAVYYCARTIFGSIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1223 - protein, 214 aa, Artificial Sequence; identical to SEQ ID NO: 955
  Synthetic Polypeptide

SEQ ID NO: 1224 - protein, 450 aa, Artificial Sequence; identical to SEQ ID NO: 1214
  Synthetic Polypeptide

SEQ ID NO: 1225 - protein, 214 aa, Artificial Sequence; identical to SEQ ID NO: 957
  Synthetic Polypeptide

SEQ ID NO: 1226 - protein, 450 aa, Artificial Sequence; identical to SEQ ID NO: 1214
  Synthetic Polypeptide

SEQ ID NO: 1227 - protein, 214 aa, Artificial Sequence; identical to SEQ ID NO: 959
  Synthetic Polypeptide

SEQ ID NO: 1228 - protein, 450 aa, Artificial Sequence; identical to SEQ ID NO: 1216
  Synthetic Polypeptide

SEQ ID NO: 1229 - protein, 214 aa, Artificial Sequence; identical to SEQ ID NO: 961
  Synthetic Polypeptide

SEQ ID NO: 1230 - protein, 450 aa, Artificial Sequence; identical to SEQ ID NO: 1216
  Synthetic Polypeptide

SEQ ID NO: 1231 - protein, 214 aa, Artificial Sequence; identical to SEQ ID NO: 963
  Synthetic Polypeptide

SEQ ID NO: 1232 - protein, 450 aa, Artificial Sequence; identical to SEQ ID NO: 1214
  Synthetic Polypeptide

SEQ ID NO: 1233 - protein, 214 aa, Artificial Sequence; identical to SEQ ID NO: 639
  Synthetic Polypeptide

SEQ ID NO: 1234 - protein, 450 aa, Artificial Sequence
  Synthetic Polypeptide
QVQLVESGGGLVKPGGSLRLSCAVSGGSISSGPYHWSWIRQAPGKGLEWVSYIYYRGGTYYNPSVKGRFTMSVDTSKNSFYLQMNSLRAEDTAVYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1235 - protein, 214 aa, Artificial Sequence; identical to SEQ ID NO: 639
  Synthetic Polypeptide

SEQ ID NO: 1236 - protein, 450 aa, Artificial Sequence
  Synthetic Polypeptide
QVQLVESGGGLVKPGGSLRLSCAVSGGSISSGPYYWSWIRQAPGKGLEWVSYIYYRGGTYYNPSVKGRFTMSVDTSKNSFYLQMNSLRAEDTAVYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1237 - protein, 214 aa, Artificial Sequence; identical to SEQ ID NO: 639
  Synthetic Polypeptide

SEQ ID NO: 1238 - protein, 450 aa, Artificial Sequence
  Synthetic Polypeptide
QVQLVESGGGLVKPGGSLRLSCAVSGGSISSGGYHWSWIRQAPGKGLEWVSYIYYRGGTYYNPSVKGRFTMSVDTSKNSFYLQMNSLRAEDTAVYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1239 - protein, 214 aa, Artificial Sequence
  Synthetic Polypeptide
DIQMTQSPSSLSASVGDRVTITCRSSQSISQYLNWYQQKPGKAPKLLIHYASSLQSGVPSRFSGSGSGTDFTLTISSLQPEDFATYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1240 - protein, 450 aa, Artificial Sequence; identical to SEQ ID NO: 1234
  Synthetic Polypeptide

SEQ ID NO: 1241 - protein, 214 aa, Artificial Sequence
  Synthetic Polypeptide
DIQMTQSPSSLSASVGDRVTITCRSSQSISTYLNWYQQKPGKAPKLLIHAASSLQSGVPSRFSGSGSGTDFTLTISSLQPEDFATYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1242 - protein, 450 aa, Artificial Sequence
  Synthetic Polypeptide
QVQLVESGGGLVKPGGSLRLSCAVSGGSISSGPYHWSWIRQAPGKGLEWVSYIYFRGGTYYNPSVKGRFTMSVDTSKNSFYLQMNSLRAEDTAVYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1243 - protein, 214 aa, Artificial Sequence
  Synthetic Polypeptide
DIQMTQSPSSLSASVGDRVTITCRSSQSISLYLNWYQQKPGKAPKLLIHSASSLQSGVPSRFSGSGSGTDFTLTISSLQPEDFATYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1244 - protein, 450 aa, Artificial Sequence; identical to SEQ ID NO: 1234
  Synthetic Polypeptide

SEQ ID NO: 1245 - protein, 214 aa, Artificial Sequence
  Synthetic Polypeptide
DIQMTQSPSSLSASVGDRVTITCRSSQSISSYLNWYQQKPGKAPKLLIHGASSLQSGVPSRFSGSGSGTDFTLTISSLQPEDFATYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1246 - protein, 450 aa, Artificial Sequence; identical to SEQ ID NO: 1234
  Synthetic Polypeptide

SEQ ID NO: 1247 - protein, 214 aa, Artificial Sequence
  Synthetic Polypeptide
DIQMTQSPSSLSASVGDRVTITCRSSQSIKKYLNWYQQKPGKAPKLLIHAASSLQSGVPSRFSGSGSGTDFTLTISSLQPEDFATYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1248 - protein, 450 aa, Artificial Sequence; identical to SEQ ID NO: 1236
  Synthetic Polypeptide

SEQ ID NO: 1249 - protein, 214 aa, Artificial Sequence
  Synthetic Polypeptide
DIQMTQSPSSLSASVGDRVTITCRSSQSISSYLNWYQQKPGKAPKLLIHAASSLQSGVPSRFSGSGSGTDFTLTISSLQPEDFATYYCQQSYTTPPSFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1250 - protein, 450 aa, Artificial Sequence; identical to SEQ ID NO: 1236
  Synthetic Polypeptide

SEQ ID NO: 1251 - protein, 214 aa, Artificial Sequence
  Synthetic Polypeptide
DIQMTQSPSSLSASVGDRVTITCVSSQSISSYLNWYQQKPGKAPKLLIHAASSLQSGVPSRFSGSGSGTDFTLTISSLQPEDFATYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1252 - protein, 450 aa, Artificial Sequence; identical to SEQ ID NO: 1234
  Synthetic Polypeptide

SEQ ID NO: 1253 - protein, 214 aa, Artificial Sequence; identical to SEQ ID NO: 639
  Synthetic Polypeptide

SEQ ID NO: 1254 - protein, 450 aa, Artificial Sequence
  Synthetic Polypeptide
QVQLVQSGAEVKKPGASVKVSCKVSGGSISSGPYHWSWIRQAPGQGLEWMGYIYYRGGTYYNPKFQGRVTMTVDTSKNTFYMELSSLRSEDTAVYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1255 - protein, 214 aa, Artificial Sequence; identical to SEQ ID NO: 639
  Synthetic Polypeptide

SEQ ID NO: 1256 - protein, 450 aa, Artificial Sequence
  Synthetic Polypeptide
QVQLVQSGAEVKKPGASVKVSCKVSGGSISSGPYYWSWIRQAPGQGLEWMGYIYYRGGTYYNPKFQGRVTMTVDTSKNTFYMELSSLRSEDTAVYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1257 - protein, 214 aa, Artificial Sequence; identical to SEQ ID NO: 639
  Synthetic Polypeptide

SEQ ID NO: 1258 - protein, 450 aa, Artificial Sequence
  Synthetic Polypeptide
QVQLVQSGAEVKKPGASVKVSCKVSGGSISSGGYHWSWIRQAPGQGLEWMGYIYYRGGTYYNPKFQGRVTMTVDTSKNTFYMELSSLRSEDTAVYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1259 - protein, 214 aa, Artificial Sequence; identical to SEQ ID NO: 1239
  Synthetic Polypeptide

SEQ ID NO: 1260 - protein, 450 aa, Artificial Sequence; identical to SEQ ID NO: 1254
  Synthetic Polypeptide

SEQ ID NO: 1261 - protein, 214 aa, Artificial Sequence; identical to SEQ ID NO: 1241
  Synthetic Polypeptide

SEQ ID NO: 1262 - protein, 450 aa, Artificial Sequence
  Synthetic Polypeptide
QVQLVQSGAEVKKPGASVKVSCKVSGGSISSGPYHWSWIRQAPGQGLEWMGYIYFRGGTYYNPKFQGRVTMTVDTSKNTFYMELSSLRSEDTAVYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1263 - protein, 214 aa, Artificial Sequence; identical to SEQ ID NO: 1243
  Synthetic Polypeptide

SEQ ID NO: 1264 - protein, 450 aa, Artificial Sequence; identical to SEQ ID NO: 1254
  Synthetic Polypeptide

SEQ ID NO: 1265 - protein, 214 aa, Artificial Sequence; identical to SEQ ID NO: 1245
  Synthetic Polypeptide

SEQ ID NO: 1266 - protein, 450 aa, Artificial Sequence; identical to SEQ ID NO: 1254
  Synthetic Polypeptide

SEQ ID NO: 1267 - protein, 214 aa, Artificial Sequence; identical to SEQ ID NO: 1247
  Synthetic Polypeptide

SEQ ID NO: 1268 - protein, 450 aa, Artificial Sequence; identical to SEQ ID NO: 1256
  Synthetic Polypeptide

SEQ ID NO: 1269 - protein, 214 aa, Artificial Sequence; identical to SEQ ID NO: 1249
  Synthetic Polypeptide

SEQ ID NO: 1270 - protein, 450 aa, Artificial Sequence; identical to SEQ ID NO: 1256
  Synthetic Polypeptide

SEQ ID NO: 1271 - protein, 214 aa, Artificial Sequence; identical to SEQ ID NO: 1251
  Synthetic Polypeptide

SEQ ID NO: 1272 - protein, 450 aa, Artificial Sequence; identical to SEQ ID NO: 1254
  Synthetic Polypeptide

SEQ ID NO: 1273 - protein, 214 aa, Artificial Sequence; identical to SEQ ID NO: 937
  Synthetic Polypeptide

SEQ ID NO: 1274 - protein, 450 aa, Artificial Sequence; identical to SEQ ID NO: 1234
  Synthetic Polypeptide

SEQ ID NO: 1275 - protein, 214 aa, Artificial Sequence; identical to SEQ ID NO: 937
  Synthetic Polypeptide

SEQ ID NO: 1276 - protein, 450 aa, Artificial Sequence; identical to SEQ ID NO: 1236
  Synthetic Polypeptide

SEQ ID NO: 1277 - protein, 214 aa, Artificial Sequence; identical to SEQ ID NO: 937
  Synthetic Polypeptide

SEQ ID NO: 1278 - protein, 450 aa, Artificial Sequence; identical to SEQ ID NO: 1238
  Synthetic Polypeptide

SEQ ID NO: 1279 - protein, 214 aa, Artificial Sequence
  Synthetic Polypeptide
EIVMTQSPATLSLSPGERATLSCRSSQSISQYLNWYQQKPGQAPRLLIHYASSLQSGIPARFSGSGSGTDFTLTISSLQPEDFAVYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1280 - protein, 450 aa, Artificial Sequence; identical to SEQ ID NO: 1234
  Synthetic Polypeptide

SEQ ID NO: 1281 - protein, 214 aa, Artificial Sequence
  Synthetic Polypeptide
EIVMTQSPATLSLSPGERATLSCRSSQSISTYLNWYQQKPGQAPRLLIHAASSLQSGIPARFSGSGSGTDFTLTISSLQPEDFAVYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1282 - protein, 450 aa, Artificial Sequence; identical to SEQ ID NO: 1242
  Synthetic Polypeptide

SEQ ID NO: 1283 - protein, 214 aa, Artificial Sequence
  Synthetic Polypeptide
EIVMTQSPATLSLSPGERATLSCRSSQSISLYLNWYQQKPGQAPRLLIHSASSLQSGIPARFSGSGSGTDFTLTISSLQPEDFAVYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1284 - protein, 450 aa, Artificial Sequence; identical to SEQ ID NO: 1234
  Synthetic Polypeptide

SEQ ID NO: 1285 - protein, 214 aa, Artificial Sequence
  Synthetic Polypeptide
EIVMTQSPATLSLSPGERATLSCRSSQSISSYLNWYQQKPGQAPRLLIHGASSLQSGIPARFSGSGSGTDFTLTISSLQPEDFAVYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1286 - protein, 450 aa, Artificial Sequence; identical to SEQ ID NO: 1234
  Synthetic Polypeptide

SEQ ID NO: 1287 - protein, 214 aa, Artificial Sequence
  Synthetic Polypeptide
EIVMTQSPATLSLSPGERATLSCRSSQSIKKYLNWYQQKPGQAPRLLIHAASSLQSGIPARFSGSGSGTDFTLTISSLQPEDFAVYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1288 - protein, 450 aa, Artificial Sequence; identical to SEQ ID NO: 1236
  Synthetic Polypeptide

SEQ ID NO: 1289 - protein, 214 aa, Artificial Sequence
  Synthetic Polypeptide
EIVMTQSPATLSLSPGERATLSCRSSQSISSYLNWYQQKPGQAPRLLIHAASSLQSGIPARFSGSGSGTDFTLTISSLQPEDFAVYYCQQSYTTPPSFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1290 - protein, 450 aa, Artificial Sequence; identical to SEQ ID NO: 1236
  Synthetic Polypeptide

SEQ ID NO: 1291 - protein, 214 aa, Artificial Sequence
  Synthetic Polypeptide
EIVMTQSPATLSLSPGERATLSCVSSQSISSYLNWYQQKPGQAPRLLIHAASSLQSGIPARFSGSGSGTDFTLTISSLQPEDFAVYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1292 - protein, 450 aa, Artificial Sequence; identical to SEQ ID NO: 1234
  Synthetic Polypeptide

SEQ ID NO: 1293 - protein, 214 aa, Artificial Sequence; identical to SEQ ID NO: 937
  Synthetic Polypeptide

SEQ ID NO: 1294 - protein, 450 aa, Artificial Sequence
  Synthetic Polypeptide
EVQLVQSGAEVKKPGESLKISCKVSGGSISSGPYHWSWIRQMPGKGLEWMGYIYYRGGTYYNPSFQGQVTMSVDTSKNTFYLQWSSLKASDTAMYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1295 - protein, 214 aa, Artificial Sequence; identical to SEQ ID NO: 937
  Synthetic Polypeptide

SEQ ID NO: 1296 - protein, 450 aa, Artificial Sequence
  Synthetic Polypeptide
EVQLVQSGAEVKKPGESLKISCKVSGGSISSGPYYWSWIRQMPGKGLEWMGYIYYRGGTYYNPSFQGQVTMSVDTSKNTFYLQWSSLKASDTAMYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1297 - protein, 214 aa, Artificial Sequence; identical to SEQ ID NO: 937
  Synthetic Polypeptide

SEQ ID NO: 1298 - protein, 450 aa, Artificial Sequence
  Synthetic Polypeptide
EVQLVQSGAEVKKPGESLKISCKVSGGSISSGGYHWSWIRQMPGKGLEWMGYIYYRGGTYYNPSFQGQVTMSVDTSKNTFYLQWSSLKASDTAMYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1299 - protein, 214 aa, Artificial Sequence; identical to SEQ ID NO: 1279
  Synthetic Polypeptide

SEQ ID NO: 1300 - protein, 450 aa, Artificial Sequence; identical to SEQ ID NO: 1294
  Synthetic Polypeptide

SEQ ID NO: 1301 - protein, 214 aa, Artificial Sequence; identical to SEQ ID NO: 1281
  Synthetic Polypeptide

SEQ ID NO: 1302 - protein, 450 aa, Artificial Sequence
  Synthetic Polypeptide
EVQLVQSGAEVKKPGESLKISCKVSGGSISSGPYHWSWIRQMPGKGLEWMGYIYFRGGTYYNPSFQGQVTMSVDTSKNTFYLQWSSLKASDTAMYYCARTIFGVIILDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1303 - protein, 214 aa, Artificial Sequence; identical to SEQ ID NO: 1283
  Synthetic Polypeptide

SEQ ID NO: 1304 - protein, 450 aa, Artificial Sequence; identical to SEQ ID NO: 1294
  Synthetic Polypeptide

SEQ ID NO: 1305 - protein, 214 aa, Artificial Sequence; identical to SEQ ID NO: 1285
  Synthetic Polypeptide

SEQ ID NO: 1306 - protein, 450 aa, Artificial Sequence; identical to SEQ ID NO: 1294
  Synthetic Polypeptide

SEQ ID NO: 1307 - protein, 214 aa, Artificial Sequence; identical to SEQ ID NO: 1287
  Synthetic Polypeptide

SEQ ID NO: 1308 - protein, 450 aa, Artificial Sequence; identical to SEQ ID NO: 1296
  Synthetic Polypeptide

SEQ ID NO: 1309 - protein, 214 aa, Artificial Sequence; identical to SEQ ID NO: 1289
  Synthetic Polypeptide

SEQ ID NO: 1310 - protein, 450 aa, Artificial Sequence; identical to SEQ ID NO: 1296
  Synthetic Polypeptide

SEQ ID NO: 1311 - protein, 214 aa, Artificial Sequence; identical to SEQ ID NO: 1291
  Synthetic Polypeptide

SEQ ID NO: 1312 - protein, 450 aa, Artificial Sequence; identical to SEQ ID NO: 1294
  Synthetic Polypeptide

SEQ ID NO: 1313 - protein, 215 aa, Artificial Sequence
  Synthetic Polypeptide
EIVLTQSPGTLSLSPGERATLSCRASQLVSSHYLAWYQQKPGQAPRLLFYGASYSATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1314 - protein, 453 aa, Artificial Sequence
  Synthetic Polypeptide
QVQLQESGPGLVKPSETLSLTCTVSGGSIPSQGYYWNWIRQPPGKGLEWIGLIQYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1315 - protein, 215 aa, Artificial Sequence; identical to SEQ ID NO: 1313
  Synthetic Polypeptide

SEQ ID NO: 1316 - protein, 453 aa, Artificial Sequence; identical to SEQ ID NO: 1314
  Synthetic Polypeptide

SEQ ID NO: 1317 - protein, 215 aa, Artificial Sequence
  Synthetic Polypeptide
EIVLTQSPGTLSLSPGERATLSCRASQLVASVYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1318 - protein, 453 aa, Artificial Sequence
  Synthetic Polypeptide
QVQLQESGPGLVKPSETLSLTCTVSGGSISSGGYLWAWIRQPPGKGLEWIGYIYYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1319 - protein, 215 aa, Artificial Sequence; identical to SEQ ID NO: 1317
  Synthetic Polypeptide

SEQ ID NO: 1320 - protein, 453 aa, Artificial Sequence; identical to SEQ ID NO: 1318
  Synthetic Polypeptide

SEQ ID NO: 1321 - protein, 215 aa, Artificial Sequence
  Synthetic Polypeptide
EIVLTQSPGTLSLSPGERATLSCRASQPVASLYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1322 - protein, 453 aa, Artificial Sequence
  Synthetic Polypeptide
QVQLQESGPGLVKPSETLSLTCTVSGGSISSGGYYWNWIRQPPGKGLEWIGYIQRSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1323 - protein, 215 aa, Artificial Sequence; identical to SEQ ID NO: 1321
  Synthetic Polypeptide

SEQ ID NO: 1324 - protein, 453 aa, Artificial Sequence; identical to SEQ ID NO: 1322
  Synthetic Polypeptide

SEQ ID NO: 1325 - protein, 215 aa, Artificial Sequence
  Synthetic Polypeptide
EIVLTQSPGTLSLSPGERATLSCRASRHVSSTYLAWYQQKPGQAPRLLFYLRSSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1326 - protein, 453 aa, Artificial Sequence
  Synthetic Polypeptide
QVQLQESGPGLVKPSETLSLTCTVSGGSISSGGYYWNWIRQPPGKGLEWIGLIQYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1327 - protein, 215 aa, Artificial Sequence; identical to SEQ ID NO: 1325
  Synthetic Polypeptide

SEQ ID NO: 1328 - protein, 453 aa, Artificial Sequence; identical to SEQ ID NO: 1326
  Synthetic Polypeptide

SEQ ID NO: 1329 - protein, 215 aa, Artificial Sequence
  Synthetic Polypeptide
EIVLTQSPGTLSLSPGERATLSCRASRPVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1330 - protein, 453 aa, Artificial Sequence
  Synthetic Polypeptide
QVQLQESGPGLVKPSETLSLTCTVSGGSMSSGGYYWNWIRQPPGKGLEWIGLITYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1331 - protein, 215 aa, Artificial Sequence; identical to SEQ ID NO: 1329
  Synthetic Polypeptide

SEQ ID NO: 1332 - protein, 453 aa, Artificial Sequence; identical to SEQ ID NO: 1330
  Synthetic Polypeptide

SEQ ID NO: 1333 - protein, 215 aa, Artificial Sequence; identical to SEQ ID NO: 1329
  Synthetic Polypeptide

SEQ ID NO: 1334 - protein, 453 aa, Artificial Sequence
  Synthetic Polypeptide
QVQLQESGPGLVKPSETLSLTCTVSGGSLSSGGYYWNWIRQPPGKGLEWIGLITYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1335 - protein, 215 aa, Artificial Sequence; identical to SEQ ID NO: 1329
  Synthetic Polypeptide

SEQ ID NO: 1336 - protein, 453 aa, Artificial Sequence; identical to SEQ ID NO: 1334
  Synthetic Polypeptide

SEQ ID NO: 1337 - protein, 215 aa, Artificial Sequence
  Synthetic Polypeptide
EIVLTQSPGTLSLSPGERATLSCRASQQVSSTYLAWYQQKPGQAPRLLFYMAYSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1338 - protein, 453 aa, Artificial Sequence
  Synthetic Polypeptide
QVQLQESGPGLVKPSETLSLTCTVSGGSISSGGYYWNWIRQPPGKGLEWIGYIQASGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1339 - protein, 215 aa, Artificial Sequence; identical to SEQ ID NO: 1337
  Synthetic Polypeptide

SEQ ID NO: 1340 - protein, 453 aa, Artificial Sequence; identical to SEQ ID NO: 1338
  Synthetic Polypeptide

SEQ ID NO: 1341 - protein, 215 aa, Artificial Sequence
  Synthetic Polypeptide
EIVLTQSPGTLSLSPGERATLSCRASQQVSSTYLAWYQQKPGQAPRLLFYLAYSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1342 - protein, 453 aa, Artificial Sequence; identical to SEQ ID NO: 1338
  Synthetic Polypeptide

SEQ ID NO: 1343 - protein, 215 aa, Artificial Sequence; identical to SEQ ID NO: 1341
  Synthetic Polypeptide

SEQ ID NO: 1344 - protein, 453 aa, Artificial Sequence; identical to SEQ ID NO: 1338
  Synthetic Polypeptide

SEQ ID NO: 1345 - protein, 215 aa, Artificial Sequence
  Synthetic Polypeptide
EIVLTQSPGTLSLSPGERATLSCRASRRVSSTYLAWYQQKPGQAPRLLFYLPSSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1346 - protein, 453 aa, Artificial Sequence
  Synthetic Polypeptide
QVQLQESGPGLVKPSETLSLTCTVSGGGIPSGGYYWNWIRQPPGKGLEWIGYIYYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1347 - protein, 215 aa, Artificial Sequence; identical to SEQ ID NO: 1345
  Synthetic Polypeptide

SEQ ID NO: 1348 - protein, 453 aa, Artificial Sequence; identical to SEQ ID NO: 1346
  Synthetic Polypeptide

SEQ ID NO: 1349 - protein, 215 aa, Artificial Sequence
  Synthetic Polypeptide
EIVLTQSPGTLSLSPGERATLSCRASQQVSSTYLAWYQQKPGQAPRLLFYMRSSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1350 - protein, 453 aa, Artificial Sequence
  Synthetic Polypeptide
QVQLQESGPGLVKPSETLSLTCTVSGGSISSGGYYWNWIRQPPGKGLEWIGYIQYTGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1351 - protein, 215 aa, Artificial Sequence; identical to SEQ ID NO: 1349
  Synthetic Polypeptide

SEQ ID NO: 1352 - protein, 453 aa, Artificial Sequence; identical to SEQ ID NO: 1350
  Synthetic Polypeptide

SEQ ID NO: 1353 - protein, 215 aa, Artificial Sequence
  Synthetic Polypeptide
EIVLTQSPGTLSLSPGERATLSCRASQQVSSTYLAWYQQKPGQAPRLLFYLRSSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1354 - protein, 453 aa, Artificial Sequence; identical to SEQ ID NO: 1350
  Synthetic Polypeptide

SEQ ID NO: 1355 - protein, 215 aa, Artificial Sequence; identical to SEQ ID NO: 1353
  Synthetic Polypeptide

SEQ ID NO: 1356 - protein, 453 aa, Artificial Sequence; identical to SEQ ID NO: 1350
  Synthetic Polypeptide

SEQ ID NO: 1357 - protein, 215 aa, Artificial Sequence
  Synthetic Polypeptide
EIVLTQSPGTLSLSPGERATLSCRASQLVSSVYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1358 - protein, 453 aa, Artificial Sequence; identical to SEQ ID NO: 1338
  Synthetic Polypeptide

SEQ ID NO: 1359 - protein, 215 aa, Artificial Sequence; identical to SEQ ID NO: 1357
  Synthetic Polypeptide

SEQ ID NO: 1360 - protein, 453 aa, Artificial Sequence; identical to SEQ ID NO: 1338
  Synthetic Polypeptide

SEQ ID NO: 1361 - protein, 215 aa, Artificial Sequence
  Synthetic Polypeptide
EIVLTQSPGTLSLSPGERATLSCRASQQVSSTYIAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1362 - protein, 453 aa, Artificial Sequence; identical to SEQ ID NO: 1322
  Synthetic Polypeptide

SEQ ID NO: 1363 - protein, 215 aa, Artificial Sequence; identical to SEQ ID NO: 1361
  Synthetic Polypeptide

SEQ ID NO: 1364 - protein, 453 aa, Artificial Sequence; identical to SEQ ID NO: 1322
  Synthetic Polypeptide

SEQ ID NO: 1365 - protein, 215 aa, Artificial Sequence
  Synthetic Polypeptide
EIVLTQSPGTLSLSPGERATLSCRASQNVASTYLAWYQQKPGQAPRLLFYGASSRVMGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1366 - protein, 453 aa, Artificial Sequence
  Synthetic Polypeptide
QVQLQESGPGLVKPSETLSLTCTVSGGSISSGGPLWNWIRQPPGKGLEWIGYIYYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1367 - protein, 215 aa, Artificial Sequence; identical to SEQ ID NO: 1365
  Synthetic Polypeptide

SEQ ID NO: 1368 - protein, 453 aa, Artificial Sequence; identical to SEQ ID NO: 1366
  Synthetic Polypeptide

SEQ ID NO: 1369 - protein, 215 aa, Artificial Sequence
  Synthetic Polypeptide
EIVLTQSPGTLSLSPGERATLSCRASQNVASTYLAWYQQKPGQAPRLLFYGASSRVLGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1370 - protein, 453 aa, Artificial Sequence; identical to SEQ ID NO: 1366
  Synthetic Polypeptide

SEQ ID NO: 1371 - protein, 215 aa, Artificial Sequence; identical to SEQ ID NO: 1369
  Synthetic Polypeptide

SEQ ID NO: 1372 - protein, 453 aa, Artificial Sequence; identical to SEQ ID NO: 1366
  Synthetic Polypeptide

SEQ ID NO: 1373 - protein, 215 aa, Artificial Sequence
  Synthetic Polypeptide
EIVLTQSPGTLSLSPGERATLSCRASQLVSSSYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1374 - protein, 453 aa, Artificial Sequence
  Synthetic Polypeptide
QVQLQESGPGLVKPSETLSLTCTVSGGSISSGGYYWNWIRQPPGKGLEWIGYIQKSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1375 - protein, 215 aa, Artificial Sequence; identical to SEQ ID NO: 1373
  Synthetic Polypeptide

SEQ ID NO: 1376 - protein, 453 aa, Artificial Sequence; identical to SEQ ID NO: 1374
  Synthetic Polypeptide

SEQ ID NO: 1377 - protein, 215 aa, Artificial Sequence; identical to SEQ ID NO: 1349
  Synthetic Polypeptide

SEQ ID NO: 1378 - protein, 453 aa, Artificial Sequence; identical to SEQ ID NO: 1326
  Synthetic Polypeptide

SEQ ID NO: 1379 - protein, 215 aa, Artificial Sequence; identical to SEQ ID NO: 1349
  Synthetic Polypeptide

SEQ ID NO: 1380 - protein, 453 aa, Artificial Sequence; identical to SEQ ID NO: 1326
  Synthetic Polypeptide

SEQ ID NO: 1381 - protein, 215 aa, Artificial Sequence; identical to SEQ ID NO: 1353
  Synthetic Polypeptide

SEQ ID NO: 1382 - protein, 453 aa, Artificial Sequence; identical to SEQ ID NO: 1326
  Synthetic Polypeptide

SEQ ID NO: 1383 - protein, 215 aa, Artificial Sequence; identical to SEQ ID NO: 1353
  Synthetic Polypeptide

SEQ ID NO: 1384 - protein, 453 aa, Artificial Sequence; identical to SEQ ID NO: 1326
  Synthetic Polypeptide

SEQ ID NO: 1385 - protein, 215 aa, Artificial Sequence
  Synthetic Polypeptide
EIVLTQSPGTLSLSPGERATLSCRASQQVASVYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1386 - protein, 453 aa, Artificial Sequence; identical to SEQ ID NO: 1350
  Synthetic Polypeptide

SEQ ID NO: 1387 - protein, 215 aa, Artificial Sequence; identical to SEQ ID NO: 1385
  Synthetic Polypeptide

SEQ ID NO: 1388 - protein, 453 aa, Artificial Sequence; identical to SEQ ID NO: 1350
  Synthetic Polypeptide

SEQ ID NO: 1389 - protein, 215 aa, Artificial Sequence
  Synthetic Polypeptide
EIVLTQSPGTLSLSPGERATLSCRASQQVSSTYLAWYQQKPGQAPRLLFYGASSRVTGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1390 - protein, 453 aa, Artificial Sequence; identical to SEQ ID NO: 1322
  Synthetic Polypeptide

SEQ ID NO: 1391 - protein, 215 aa, Artificial Sequence; identical to SEQ ID NO: 1389
  Synthetic Polypeptide

SEQ ID NO: 1392 - protein, 453 aa, Artificial Sequence; identical to SEQ ID NO: 1322
  Synthetic Polypeptide

SEQ ID NO: 1393 - protein, 215 aa, Artificial Sequence
  Synthetic Polypeptide
EIVLTQSPGTLSLSPGERATLSCRASQQVSSLYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1394 - protein, 453 aa, Artificial Sequence; identical to SEQ ID NO: 1322
  Synthetic Polypeptide

SEQ ID NO: 1395 - protein, 215 aa, Artificial Sequence; identical to SEQ ID NO: 1393
  Synthetic Polypeptide

SEQ ID NO: 1396 - protein, 453 aa, Artificial Sequence; identical to SEQ ID NO: 1322
  Synthetic Polypeptide

SEQ ID NO: 1397 - protein, 215 aa, Artificial Sequence; identical to SEQ ID NO: 210
  Synthetic Polypeptide

SEQ ID NO: 1398 - protein, 453 aa, Artificial Sequence; identical to SEQ ID NO: 1374
  Synthetic Polypeptide

SEQ ID NO: 1399 - protein, 215 aa, Artificial Sequence; identical to SEQ ID NO: 210
  Synthetic Polypeptide

SEQ ID NO: 1400 - protein, 453 aa, Artificial Sequence; identical to SEQ ID NO: 1374
  Synthetic Polypeptide

SEQ ID NO: 1401 - protein, 215 aa, Artificial Sequence; identical to SEQ ID NO: 1317
  Synthetic Polypeptide

SEQ ID NO: 1402 - protein, 453 aa, Artificial Sequence
  Synthetic Polypeptide
QVQLQESGPGLVKPSETLSLTCTVSGGSISSPGLYWNWIRQPPGKGLEWIGYIYKSGSTFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1403 - protein, 215 aa, Artificial Sequence; identical to SEQ ID NO: 1317
  Synthetic Polypeptide

SEQ ID NO: 1404 - protein, 453 aa, Artificial Sequence; identical to SEQ ID NO: 1402
  Synthetic Polypeptide

SEQ ID NO: 1405 - protein, 215 aa, Artificial Sequence
  Synthetic Polypeptide
EIVLTQSPGTLSLSPGERATLSCRASRFVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1406 - protein, 453 aa, Artificial Sequence
  Synthetic Polypeptide
QVQLQESGPGLVKPSETLSLTCTVSGGSISSGGLLWNWIRQPPGKGLEWIGYIYYSGSTFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1407 - protein, 215 aa, Artificial Sequence; identical to SEQ ID NO: 1405
  Synthetic Polypeptide

SEQ ID NO: 1408 - protein, 453 aa, Artificial Sequence; identical to SEQ ID NO: 1406
  Synthetic Polypeptide

SEQ ID NO: 1409 - protein, 215 aa, Artificial Sequence
  Synthetic Polypeptide
EIVLTQSPGTLSLSPGERATLSCRADRQVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1410 - protein, 453 aa, Artificial Sequence
  Synthetic Polypeptide
QVQLQESGPGLVKPSETLSLTCTVSGGSISSGGYYWNWIRQPPGKGLEWIGYIYKSGSTFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1411 - protein, 215 aa, Artificial Sequence; identical to SEQ ID NO: 1409
  Synthetic Polypeptide

SEQ ID NO: 1412 - protein, 453 aa, Artificial Sequence; identical to SEQ ID NO: 1410
  Synthetic Polypeptide

SEQ ID NO: 1413 - protein, 215 aa, Artificial Sequence; identical to SEQ ID NO: 1313
  Synthetic Polypeptide

SEQ ID NO: 1414 - protein, 453 aa, Artificial Sequence
  Synthetic Polypeptide
QVQLQESGPGLVKPSETLSLTCTVSGGYIPSGGYYWNWIRQPPGKGLEWIGLIQYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1415 - protein, 215 aa, Artificial Sequence; identical to SEQ ID NO: 1313
  Synthetic Polypeptide

SEQ ID NO: 1416 - protein, 453 aa, Artificial Sequence; identical to SEQ ID NO: 1414
  Synthetic Polypeptide

SEQ ID NO: 1417 - protein, 215 aa, Artificial Sequence
  Synthetic Polypeptide
EIVLTQSPGTLSLSPGERATLSCRASQNVASAYLAWYQQKPGQAPRLLFYGASSRATGIPDRFSRSGSGTDFTLTISRLEPEDFAVYYCQQYDVVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1418 - protein, 453 aa, Artificial Sequence
  Synthetic Polypeptide
QVQLQESGPGLVKPSETLSLTCTVSGGSISSGGYYWNWIRQPPGKGLEWIGYIYKAGSTFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1419 - protein, 215 aa, Artificial Sequence; identical to SEQ ID NO: 1417
  Synthetic Polypeptide

SEQ ID NO: 1420 - protein, 453 aa, Artificial Sequence; identical to SEQ ID NO: 1418
  Synthetic Polypeptide

SEQ ID NO: 1421 - protein, 215 aa, Artificial Sequence
  Synthetic Polypeptide
EIVLTQSPGTLSLSPGERATLSCRASQQVSSTYLAWYQQKPGQAPRLLFYLPSSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1422 - protein, 453 aa, Artificial Sequence
  Synthetic Polypeptide
QVQLQESGPGLVKPSETLSLTCTVSGGSISSGGYYWNWIRQPPGKGLEWIGYTYPSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1423 - protein, 215 aa, Artificial Sequence; identical to SEQ ID NO: 1421
  Synthetic Polypeptide

SEQ ID NO: 1424 - protein, 453 aa, Artificial Sequence; identical to SEQ ID NO: 1422
  Synthetic Polypeptide

SEQ ID NO: 1425 - protein, 215 aa, Artificial Sequence; identical to SEQ ID NO: 1321
  Synthetic Polypeptide

SEQ ID NO: 1426 - protein, 453 aa, Artificial Sequence; identical to SEQ ID NO: 1326
  Synthetic Polypeptide

SEQ ID NO: 1427 - protein, 215 aa, Artificial Sequence; identical to SEQ ID NO: 1321
  Synthetic Polypeptide

SEQ ID NO: 1428 - protein, 453 aa, Artificial Sequence; identical to SEQ ID NO: 1326
  Synthetic Polypeptide

SEQ ID NO: 1429 - protein, 215 aa, Artificial Sequence; identical to SEQ ID NO: 210
  Synthetic Polypeptide

SEQ ID NO: 1430 - protein, 453 aa, Artificial Sequence; identical to SEQ ID NO: 1350
  Synthetic Polypeptide

SEQ ID NO: 1431 - protein, 215 aa, Artificial Sequence; identical to SEQ ID NO: 210
  Synthetic Polypeptide

SEQ ID NO: 1432 - protein, 453 aa, Artificial Sequence; identical to SEQ ID NO: 1350
  Synthetic Polypeptide

SEQ ID NO: 1433 - protein, 215 aa, Artificial Sequence; identical to SEQ ID NO: 210
  Synthetic Polypeptide

SEQ ID NO: 1434 - protein, 453 aa, Artificial Sequence
  Synthetic Polypeptide
QVQLQESGPGLVKPSETLSLTCTVSGGSISSGGYYWNWIRQPPGKGLEWIGFIQYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1435 - protein, 215 aa, Artificial Sequence; identical to SEQ ID NO: 210
  Synthetic Polypeptide

SEQ ID NO: 1436 - protein, 453 aa, Artificial Sequence; identical to SEQ ID NO: 1434
  Synthetic Polypeptide

SEQ ID NO: 1437 - protein, 215 aa, Artificial Sequence
  Synthetic Polypeptide
EIVLTQSPGTLSLSPGERATLSCRASQHVASTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1438 - protein, 453 aa, Artificial Sequence
  Synthetic Polypeptide
QVQLQESGPGLVKPSETLSLTCTVSGGSISSGGYYWNWIRQPPGKGLEWIGYTQYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1439 - protein, 215 aa, Artificial Sequence; identical to SEQ ID NO: 1437
  Synthetic Polypeptide

SEQ ID NO: 1440 - protein, 453 aa, Artificial Sequence; identical to SEQ ID NO: 1438
  Synthetic Polypeptide

SEQ ID NO: 1441 - protein, 215 aa, Artificial Sequence
  Synthetic Polypeptide
EIVLTQSPGTLSLSPGERATLSCRASRQVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1442 - protein, 453 aa, Artificial Sequence; identical to SEQ ID NO: 1326
  Synthetic Polypeptide

SEQ ID NO: 1443 - protein, 215 aa, Artificial Sequence; identical to SEQ ID NO: 1441
  Synthetic Polypeptide

SEQ ID NO: 1444 - protein, 453 aa, Artificial Sequence; identical to SEQ ID NO: 1326
  Synthetic Polypeptide

SEQ ID NO: 1445 - protein, 215 aa, Artificial Sequence
  Synthetic Polypeptide
EIVLTQSPGTLSLSPGERATLSCRASQLVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1446 - protein, 453 aa, Artificial Sequence; identical to SEQ ID NO: 1326
  Synthetic Polypeptide

SEQ ID NO: 1447 - protein, 215 aa, Artificial Sequence; identical to SEQ ID NO: 1445
  Synthetic Polypeptide

SEQ ID NO: 1448 - protein, 453 aa, Artificial Sequence; identical to SEQ ID NO: 1326
  Synthetic Polypeptide

SEQ ID NO: 1449 - protein, 215 aa, Artificial Sequence
  Synthetic Polypeptide
EIVLTQSPGTLSLSPGERATLSCRASQKVASTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1450 - protein, 453 aa, Artificial Sequence; identical to SEQ ID NO: 1422
  Synthetic Polypeptide

SEQ ID NO: 1451 - protein, 215 aa, Artificial Sequence; identical to SEQ ID NO: 1449
  Synthetic Polypeptide

SEQ ID NO: 1452 - protein, 453 aa, Artificial Sequence; identical to SEQ ID NO: 1422
  Synthetic Polypeptide

SEQ ID NO: 1453 - protein, 215 aa, Artificial Sequence
  Synthetic Polypeptide
EIVLTQSPGTLSLSPGERATLSCRASQFVASTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1454 - protein, 453 aa, Artificial Sequence
  Synthetic Polypeptide
QVQLQESGPGLVKPSETLSLTCTVSGGSISSGGPIWNWIRQPPGKGLEWIGYIYRSGSTFYNPSLKSRVTISVDTSKNQFSLKLSSVTAADTAVYYCARAPRYNWDRGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1455 - protein, 215 aa, Artificial Sequence; identical to SEQ ID NO: 1453
  Synthetic Polypeptide

SEQ ID NO: 1456 - protein, 453 aa, Artificial Sequence; identical to SEQ ID NO: 1454
  Synthetic Polypeptide

SEQ ID NO: 1457 - protein, 215 aa, Artificial Sequence
  Synthetic Polypeptide
EIVLTQSPGTLSLSPGERATLSCRASQQVSSTYLAWYQQKPGQAPRLLFYGASERLTGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1458 - protein, 453 aa, Artificial Sequence; identical to SEQ ID NO: 1322
  Synthetic Polypeptide

SEQ ID NO: 1459 - protein, 215 aa, Artificial Sequence; identical to SEQ ID NO: 1457
  Synthetic Polypeptide

SEQ ID NO: 1460 - protein, 453 aa, Artificial Sequence; identical to SEQ ID NO: 1322
  Synthetic Polypeptide

SEQ ID NO: 1461 - protein, 215 aa, Artificial Sequence; identical to SEQ ID NO: 120
  Synthetic Polypeptide

SEQ ID NO: 1462 - protein, 453 aa, Artificial Sequence; identical to SEQ ID NO: 1410
  Synthetic Polypeptide

SEQ ID NO: 1463 - protein, 215 aa, Artificial Sequence; identical to SEQ ID NO: 120
  Synthetic Polypeptide

SEQ ID NO: 1464 - protein, 453 aa, Artificial Sequence; identical to SEQ ID NO: 1410
  Synthetic Polypeptide

SEQ ID NO: 1465 - protein, 215 aa, Artificial Sequence
  Synthetic Polypeptide
EIVLTQSPGTLSLSPGERATLSCRASQNVASAYLAWYQQKPGQAPRLLFYGASSRATGIPDRFSRSGSGTDFTLTISRLEPEDFAVYYCQQYDVFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1466 - protein, 453 aa, Artificial Sequence; identical to SEQ ID NO: 1418
  Synthetic Polypeptide

SEQ ID NO: 1467 - protein, 215 aa, Artificial Sequence; identical to SEQ ID NO: 1465
  Synthetic Polypeptide

SEQ ID NO: 1468 - protein, 453 aa, Artificial Sequence; identical to SEQ ID NO: 1418
  Synthetic Polypeptide

SEQ ID NO: 1469 - protein, 215 aa, Artificial Sequence
  Synthetic Polypeptide
EIVLTQSPGTLSLSPGERATLSCRASQNVASPYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1470 - protein, 453 aa, Artificial Sequence; identical to SEQ ID NO: 1326
  Synthetic Polypeptide

SEQ ID NO: 1471 - protein, 215 aa, Artificial Sequence; identical to SEQ ID NO: 1469
  Synthetic Polypeptide

SEQ ID NO: 1472 - protein, 453 aa, Artificial Sequence; identical to SEQ ID NO: 1326
  Synthetic Polypeptide

SEQ ID NO: 1473 - protein, 215 aa, Artificial Sequence; identical to SEQ ID NO: 1393
  Synthetic Polypeptide

SEQ ID NO: 1474 - protein, 453 aa, Artificial Sequence; identical to SEQ ID NO: 1350
  Synthetic Polypeptide

SEQ ID NO: 1475 - protein, 215 aa, Artificial Sequence; identical to SEQ ID NO: 1393
  Synthetic Polypeptide

SEQ ID NO: 1476 - protein, 453 aa, Artificial Sequence; identical to SEQ ID NO: 1350
  Synthetic Polypeptide

SEQ ID NO: 1477 - protein, 215 aa, Artificial Sequence
  Synthetic Polypeptide
EIVLTQSPGTLSLSPGERATLSCRASKLVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1478 - protein, 453 aa, Artificial Sequence; identical to SEQ ID NO: 1326
  Synthetic Polypeptide

SEQ ID NO: 1479 - protein, 215 aa, Artificial Sequence; identical to SEQ ID NO: 1477
  Synthetic Polypeptide

SEQ ID NO: 1480 - protein, 453 aa, Artificial Sequence; identical to SEQ ID NO: 1326
  Synthetic Polypeptide

SEQ ID NO: 1481 - protein, 215 aa, Artificial Sequence
  Synthetic Polypeptide
EIVLTQSPGTLSLSPGERATLSCRASQQVSSHYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1482 - protein, 453 aa, Artificial Sequence
  Synthetic Polypeptide
QVQLQESGPGLVKPSETLSLTCTVSGGSISSGGYYWNWIRQPPGKGLEWIGYIQSSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1483 - protein, 215 aa, Artificial Sequence; identical to SEQ ID NO: 1481
  Synthetic Polypeptide

SEQ ID NO: 1484 - protein, 453 aa, Artificial Sequence; identical to SEQ ID NO: 1482
  Synthetic Polypeptide

SEQ ID NO: 1485 - protein, 215 aa, Artificial Sequence
  Synthetic Polypeptide
EIVLTQSPGTLSLSPGERATLSCRASQQVSSTYLAWYQQKPGQAPRLLFYLHSSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1486 - protein, 453 aa, Artificial Sequence; identical to SEQ ID NO: 1410
  Synthetic Polypeptide

SEQ ID NO: 1487 - protein, 215 aa, Artificial Sequence; identical to SEQ ID NO: 1485
  Synthetic Polypeptide

SEQ ID NO: 1488 - protein, 453 aa, Artificial Sequence; identical to SEQ ID NO: 1410
  Synthetic Polypeptide

SEQ ID NO: 1489 - protein, 215 aa, Artificial Sequence
  Synthetic Polypeptide
EIVLTQSPGTLSLSPGERATLSCRASQAVASTYLAWYQQKPGQAPRLLFYGASSRATGIPDRFSRSGSGTDFTLTISRLEPEDFAVYYCQQYDNHPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1490 - protein, 453 aa, Artificial Sequence
  Synthetic Polypeptide
QVQLQESGPGLVKPSETLSLTCTVSGGSISSGGYYWNWIRQPPGKGLEWIGYIQRSGSTFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1491 - protein, 215 aa, Artificial Sequence; identical to SEQ ID NO: 1489
  Synthetic Polypeptide

SEQ ID NO: 1492 - protein, 453 aa, Artificial Sequence; identical to SEQ ID NO: 1490
  Synthetic Polypeptide

SEQ ID NO: 1493 - protein, 215 aa, Artificial Sequence; identical to SEQ ID NO: 1317
  Synthetic Polypeptide

SEQ ID NO: 1494 - protein, 453 aa, Artificial Sequence
  Synthetic Polypeptide
QVQLQESGPGLVKPSETLSLTCTVSGGSIRPGGYYWNWIRQPPGKGLEWIGYIYYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1495 - protein, 215 aa, Artificial Sequence; identical to SEQ ID NO: 1317
  Synthetic Polypeptide

SEQ ID NO: 1496 - protein, 453 aa, Artificial Sequence; identical to SEQ ID NO: 1494
  Synthetic Polypeptide

SEQ ID NO: 1497 - protein, 215 aa, Artificial Sequence; identical to SEQ ID NO: 1385
  Synthetic Polypeptide

SEQ ID NO: 1498 - protein, 453 aa, Artificial Sequence
  Synthetic Polypeptide
QVQLQESGPGLVKPSETLSLTCTVSGGSISSGGYYWNWIRQPPGKGLEWIGYAYASGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1499 - protein, 215 aa, Artificial Sequence; identical to SEQ ID NO: 1385
  Synthetic Polypeptide

SEQ ID NO: 1500 - protein, 453 aa, Artificial Sequence; identical to SEQ ID NO: 1498
  Synthetic Polypeptide

SEQ ID NO: 1501 - protein, 215 aa, Artificial Sequence
  Synthetic Polypeptide
EIVLTQSPGTLSLSPGERATLSCRASQQVSSTYLAWYQQKPGQAPRLLFYGASSRVPGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1502 - protein, 453 aa, Artificial Sequence; identical to SEQ ID NO: 1366
  Synthetic Polypeptide

SEQ ID NO: 1503 - protein, 215 aa, Artificial Sequence; identical to SEQ ID NO: 1501
  Synthetic Polypeptide

SEQ ID NO: 1504 - protein, 453 aa, Artificial Sequence; identical to SEQ ID NO: 1366
  Synthetic Polypeptide

SEQ ID NO: 1505 - protein, 215 aa, Artificial Sequence
  Synthetic Polypeptide
EIVLTQSPGTLSLSPGERATLSCRASQHVSSHYLAWYQQKPGQAPRLLFYGASSRATGIPDRFSRSGSGTDFTLTISRLEPEDFAVYYCQQYGLVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1506 - protein, 453 aa, Artificial Sequence; identical to SEQ ID NO: 1338
  Synthetic Polypeptide

SEQ ID NO: 1507 - protein, 215 aa, Artificial Sequence; identical to SEQ ID NO: 1505
  Synthetic Polypeptide

SEQ ID NO: 1508 - protein, 453 aa, Artificial Sequence; identical to SEQ ID NO: 1338
  Synthetic Polypeptide

SEQ ID NO: 1509 - protein, 215 aa, Artificial Sequence
  Synthetic Polypeptide
EIVLTQSPGTLSLSPGERATLSCRASRNVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1510 - protein, 453 aa, Artificial Sequence
  Synthetic Polypeptide
QVQLQESGPGLVKPSETLSLTCTVSGGSISSGGYYWNWIRQPPGKGLEWIGYITYRGSTFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1511 - protein, 215 aa, Artificial Sequence; identical to SEQ ID NO: 1509
  Synthetic Polypeptide

SEQ ID NO: 1512 - protein, 453 aa, Artificial Sequence; identical to SEQ ID NO: 1510
  Synthetic Polypeptide

SEQ ID NO: 1513 - protein, 215 aa, Artificial Sequence
  Synthetic Polypeptide
EIVLTQSPGTLSLSPGERATLSCRASQLVASHYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1514 - protein, 453 aa, Artificial Sequence; identical to SEQ ID NO: 119
  Synthetic Polypeptide

SEQ ID NO: 1515 - protein, 215 aa, Artificial Sequence; identical to SEQ ID NO: 1513
  Synthetic Polypeptide

SEQ ID NO: 1516 - protein, 453 aa, Artificial Sequence; identical to SEQ ID NO: 119
  Synthetic Polypeptide

SEQ ID NO: 1517 - protein, 215 aa, Artificial Sequence; identical to SEQ ID NO: 1513
  Synthetic Polypeptide

SEQ ID NO: 1518 - protein, 453 aa, Artificial Sequence
  Synthetic Polypeptide
QVQLQESGPGLVKPSETLSLTCTVSGGSISSGGYYWNWIRQPPGKGLEWIGYIYRAGSTFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1519 - protein, 215 aa, Artificial Sequence; identical to SEQ ID NO: 1513
  Synthetic Polypeptide

SEQ ID NO: 1520 - protein, 453 aa, Artificial Sequence; identical to SEQ ID NO: 1518
  Synthetic Polypeptide

SEQ ID NO: 1521 - protein, 215 aa, Artificial Sequence
  Synthetic Polypeptide
EIVLTQSPGTLSLSPGERATLSCRASRYVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1522 - protein, 453 aa, Artificial Sequence
  Synthetic Polypeptide
QVQLQESGPGLVKPSETLSLTCTVSGGSISSGGPIWNWIRQPPGKGLEWIGYIYYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1523 - protein, 215 aa, Artificial Sequence; identical to SEQ ID NO: 1521
  Synthetic Polypeptide

SEQ ID NO: 1524 - protein, 453 aa, Artificial Sequence; identical to SEQ ID NO: 1522
  Synthetic Polypeptide

SEQ ID NO: 1525 - protein, 215 aa, Artificial Sequence
  Synthetic Polypeptide
EIVLTQSPGTLSLSPGERATLSCRASQKVASAYLAWYQQKPGQAPRLLFYGASSRATGIPDRFSRSGSGTDFTLTISRLEPEDFAVYYCQQYDNIPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1526 - protein, 453 aa, Artificial Sequence
  Synthetic Polypeptide
QVQLQESGPGLVKPSETLSLTCTVSGGSISSGGYYWNWIRQPPGKGLEWIGYIYRAGATFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1527 - protein, 215 aa, Artificial Sequence; identical to SEQ ID NO: 1525
  Synthetic Polypeptide

SEQ ID NO: 1528 - protein, 453 aa, Artificial Sequence; identical to SEQ ID NO: 1526
  Synthetic Polypeptide

SEQ ID NO: 1529 - protein, 215 aa, Artificial Sequence; identical to SEQ ID NO: 1329
  Synthetic Polypeptide

SEQ ID NO: 1530 - protein, 453 aa, Artificial Sequence
  Synthetic Polypeptide
QVQLQESGPGLVKPSETLSLTCTVSGGVISSGGYYWNWIRQPPGKGLEWIGYIQASGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1531 - protein, 215 aa, Artificial Sequence; identical to SEQ ID NO: 1329
  Synthetic Polypeptide

SEQ ID NO: 1532 - protein, 453 aa, Artificial Sequence; identical to SEQ ID NO: 1530
  Synthetic Polypeptide

SEQ ID NO: 1533 - protein, 215 aa, Artificial Sequence; identical to SEQ ID NO: 1445
  Synthetic Polypeptide

SEQ ID NO: 1534 - protein, 453 aa, Artificial Sequence
  Synthetic Polypeptide
QVQLQESGPGLVKPSETLSLTCTVSGGSITSGGYYWNWIRQPPGKGLEWIGLIQYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1535 - protein, 215 aa, Artificial Sequence; identical to SEQ ID NO: 1445
  Synthetic Polypeptide

SEQ ID NO: 1536 - protein, 453 aa, Artificial Sequence; identical to SEQ ID NO: 1534
  Synthetic Polypeptide

SEQ ID NO: 1537 - protein, 215 aa, Artificial Sequence
  Synthetic Polypeptide
EIVLTQSPGTLSLSPGERATLSCRASQLVASAYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1538 - protein, 453 aa, Artificial Sequence; identical to SEQ ID NO: 1422
  Synthetic Polypeptide

SEQ ID NO: 1539 - protein, 215 aa, Artificial Sequence; identical to SEQ ID NO: 1537
  Synthetic Polypeptide

SEQ ID NO: 1540 - protein, 453 aa, Artificial Sequence; identical to SEQ ID NO: 1422
  Synthetic Polypeptide

SEQ ID NO: 1541 - protein, 215 aa, Artificial Sequence; identical to SEQ ID NO: 1537
  Synthetic Polypeptide

SEQ ID NO: 1542 - protein, 453 aa, Artificial Sequence
  Synthetic Polypeptide
QVQLQESGPGLVKPSETLSLTCTVSGGSFSRGGYYWNWIRQPPGKGLEWIGYIYYSGSTFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1543 - protein, 215 aa, Artificial Sequence; identical to SEQ ID NO: 1537
  Synthetic Polypeptide

SEQ ID NO: 1544 - protein, 453 aa, Artificial Sequence; identical to SEQ ID NO: 1542
  Synthetic Polypeptide

SEQ ID NO: 1545 - protein, 215 aa, Artificial Sequence
  Synthetic Polypeptide
EIVLTQSPGTLSLSPGERATLSCRASQKVASSYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1546 - protein, 453 aa, Artificial Sequence; identical to SEQ ID NO: 1326
  Synthetic Polypeptide

SEQ ID NO: 1547 - protein, 215 aa, Artificial Sequence; identical to SEQ ID NO: 1545
  Synthetic Polypeptide

SEQ ID NO: 1548 - protein, 453 aa, Artificial Sequence; identical to SEQ ID NO: 1326
  Synthetic Polypeptide

SEQ ID NO: 1549 - protein, 215 aa, Artificial Sequence; identical to SEQ ID NO: 1385
  Synthetic Polypeptide

SEQ ID NO: 1550 - protein, 453 aa, Artificial Sequence
  Synthetic Polypeptide
QVQLQESGPGLVKPSETLSLTCTVSGGSISSGGYLWSWIRQPPGKGLEWIGYIYYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1551 - protein, 215 aa, Artificial Sequence; identical to SEQ ID NO: 1385
  Synthetic Polypeptide

SEQ ID NO: 1552 - protein, 453 aa, Artificial Sequence; identical to SEQ ID NO: 1550
  Synthetic Polypeptide

SEQ ID NO: 1553 - protein, 215 aa, Artificial Sequence
  Synthetic Polypeptide
EIVLTQSPGTLSLSPGERATLSCRASQQVASHYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1554 - protein, 453 aa, Artificial Sequence
  Synthetic Polypeptide
QVQLQESGPGLVKPSETLSLTCTVSGGSIGSTGYYWNWIRQPPGKGLEWIGYIYRFGSTFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1555 - protein, 215 aa, Artificial Sequence; identical to SEQ ID NO: 1553
  Synthetic Polypeptide

SEQ ID NO: 1556 - protein, 453 aa, Artificial Sequence; identical to SEQ ID NO: 1554
  Synthetic Polypeptide

SEQ ID NO: 1557 - protein, 215 aa, Artificial Sequence
  Synthetic Polypeptide
EIVLTQSPGTLSLSPGERATLSCRASRRVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1558 - protein, 453 aa, Artificial Sequence
  Synthetic Polypeptide
QVQLQESGPGLVKPSETLSLTCTVSGGSFSPGGYYWNWIRQPPGKGLEWIGYIYYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1559 - protein, 215 aa, Artificial Sequence; identical to SEQ ID NO: 1557
  Synthetic Polypeptide

SEQ ID NO: 1560 - protein, 453 aa, Artificial Sequence; identical to SEQ ID NO: 1558
  Synthetic Polypeptide

SEQ ID NO: 1561 - protein, 215 aa, Artificial Sequence
  Synthetic Polypeptide
EIVLTQSPGTLSLSPGERATLSCRASQQVSSTYLAWYQQKPGQAPRLLFYGASPFATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1562 - protein, 453 aa, Artificial Sequence; identical to SEQ ID NO: 1338
  Synthetic Polypeptide

SEQ ID NO: 1563 - protein, 215 aa, Artificial Sequence; identical to SEQ ID NO: 1561
  Synthetic Polypeptide

SEQ ID NO: 1564 - protein, 453 aa, Artificial Sequence; identical to SEQ ID NO: 1338
  Synthetic Polypeptide

SEQ ID NO: 1565 - protein, 215 aa, Artificial Sequence; identical to SEQ ID NO: 120
  Synthetic Polypeptide

SEQ ID NO: 1566 - protein, 453 aa, Artificial Sequence; identical to SEQ ID NO: 119
  Synthetic Polypeptide

SEQ ID NO: 1567 - protein, 215 aa, Artificial Sequence
  Synthetic Polypeptide
EIVLTQSPGTLSLSPGERATLSCRASRQLSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1568 - protein, 453 aa, Artificial Sequence; identical to SEQ ID NO: 1326
  Synthetic Polypeptide

SEQ ID NO: 1569 - protein, 215 aa, Artificial Sequence; identical to SEQ ID NO: 1567
  Synthetic Polypeptide

SEQ ID NO: 1570 - protein, 453 aa, Artificial Sequence; identical to SEQ ID NO: 1326
  Synthetic Polypeptide

SEQ ID NO: 1571 - protein, 215 aa, Artificial Sequence; identical to SEQ ID NO: 1357
  Synthetic Polypeptide

SEQ ID NO: 1572 - protein, 453 aa, Artificial Sequence; identical to SEQ ID NO: 1410
  Synthetic Polypeptide

SEQ ID NO: 1573 - protein, 215 aa, Artificial Sequence; identical to SEQ ID NO: 1357
  Synthetic Polypeptide

SEQ ID NO: 1574 - protein, 453 aa, Artificial Sequence; identical to SEQ ID NO: 1410
  Synthetic Polypeptide

SEQ ID NO: 1575 - protein, 215 aa, Artificial Sequence
  Synthetic Polypeptide
EIVLTQSPGTLSLSPGERATLSCRASQLVASTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1576 - protein, 453 aa, Artificial Sequence; identical to SEQ ID NO: 1410
  Synthetic Polypeptide

SEQ ID NO: 1577 - protein, 215 aa, Artificial Sequence; identical to SEQ ID NO: 1575
  Synthetic Polypeptide

SEQ ID NO: 1578 - protein, 453 aa, Artificial Sequence; identical to SEQ ID NO: 1410
  Synthetic Polypeptide

SEQ ID NO: 1579 - protein, 215 aa, Artificial Sequence
  Synthetic Polypeptide
EIVLTQSPGTLSLSPGERATLSCRASQLVSSHYLAWYQQKPGQAPRLLFYGASSRATGIPDRFSRSGSGTDFTLTISRLEPEDFAVYYCQQYDLVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1580 - protein, 453 aa, Artificial Sequence
  Synthetic Polypeptide
QVQLQESGPGLVKPSETLSLTCTVSGGSISSGGYYWNWIRQPPGKGLEWIGYIYRSGQTLYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1581 - protein, 215 aa, Artificial Sequence; identical to SEQ ID NO: 1579
  Synthetic Polypeptide

SEQ ID NO: 1582 - protein, 453 aa, Artificial Sequence; identical to SEQ ID NO: 1580
  Synthetic Polypeptide

SEQ ID NO: 1583 - protein, 215 aa, Artificial Sequence
  Synthetic Polypeptide
EIVLTQSPGTLSLSPGERATLSCRASQNVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1584 - protein, 453 aa, Artificial Sequence
  Synthetic Polypeptide
QVQLQESGPGLVKPSETLSLTCTVSGGSISSGGYYWNWIRQPPGKGLEWIGYIYRSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1585 - protein, 215 aa, Artificial Sequence; identical to SEQ ID NO: 1583
  Synthetic Polypeptide

SEQ ID NO: 1586 - protein, 453 aa, Artificial Sequence; identical to SEQ ID NO: 1584
  Synthetic Polypeptide

SEQ ID NO: 1587 - protein, 215 aa, Artificial Sequence; identical to SEQ ID NO: 1525
  Synthetic Polypeptide

SEQ ID NO: 1588 - protein, 453 aa, Artificial Sequence
  Synthetic Polypeptide
QVQLQESGPGLVKPSETLSLTCTVSGGSISSGGYYWNWIRQPPGKGLEWIGYIYRNGDTFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1589 - protein, 215 aa, Artificial Sequence; identical to SEQ ID NO: 1525
  Synthetic Polypeptide

SEQ ID NO: 1590 - protein, 453 aa, Artificial Sequence; identical to SEQ ID NO: 1588
  Synthetic Polypeptide

SEQ ID NO: 1591 - protein, 215 aa, Artificial Sequence
  Synthetic Polypeptide
EIVLTQSPGTLSLSPGERATLSCRSSRQVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1592 - protein, 453 aa, Artificial Sequence
  Synthetic Polypeptide
QVQLQESGPGLVKPSETLSLTCTVSGGPIPSGGYYWNWIRQPPGKGLEWIGYIYYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1593 - protein, 215 aa, Artificial Sequence; identical to SEQ ID NO: 1591
  Synthetic Polypeptide

SEQ ID NO: 1594 - protein, 453 aa, Artificial Sequence; identical to SEQ ID NO: 1592
  Synthetic Polypeptide

SEQ ID NO: 1595 - protein, 215 aa, Artificial Sequence; identical to SEQ ID NO: 1525
  Synthetic Polypeptide

SEQ ID NO: 1596 - protein, 453 aa, Artificial Sequence
  Synthetic Polypeptide
QVQLQESGPGLVKPSETLSLTCTVSGGSISSGGYYWNWIRQPPGKGLEWIGYIYRSGSTFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1597 - protein, 215 aa, Artificial Sequence; identical to SEQ ID NO: 1525
  Synthetic Polypeptide

SEQ ID NO: 1598 - protein, 453 aa, Artificial Sequence; identical to SEQ ID NO: 1596
  Synthetic Polypeptide

SEQ ID NO: 1599 - protein, 215 aa, Artificial Sequence; identical to SEQ ID NO: 1513
  Synthetic Polypeptide

SEQ ID NO: 1600 - protein, 453 aa, Artificial Sequence
  Synthetic Polypeptide
QVQLQESGPGLVKPSETLSLTCTVSGGSIPSSGYYWNWIRQPPGKGLEWIGYIYYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1601 - protein, 215 aa, Artificial Sequence; identical to SEQ ID NO: 1513
  Synthetic Polypeptide

SEQ ID NO: 1602 - protein, 453 aa, Artificial Sequence; identical to SEQ ID NO: 1600
  Synthetic Polypeptide

SEQ ID NO: 1603 - protein, 215 aa, Artificial Sequence; identical to SEQ ID NO: 1509
  Synthetic Polypeptide

SEQ ID NO: 1604 - protein, 453 aa, Artificial Sequence
  Synthetic Polypeptide
QVQLQESGPGLVKPSETLSLTCTVSGGSISSGGYYWNWIRQPPGKGLEWIGYIYPKGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1605 - protein, 215 aa, Artificial Sequence; identical to SEQ ID NO: 1509
  Synthetic Polypeptide

SEQ ID NO: 1606 - protein, 453 aa, Artificial Sequence; identical to SEQ ID NO: 1604
  Synthetic Polypeptide

SEQ ID NO: 1607 - protein, 215 aa, Artificial Sequence; identical to SEQ ID NO: 1441
  Synthetic Polypeptide

SEQ ID NO: 1608 - protein, 453 aa, Artificial Sequence
  Synthetic Polypeptide
QVQLQESGPGLVKPSETLSLTCTVSGGSISSGGYYWNWIRQPPGKGLEWIGYVQYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1609 - protein, 215 aa, Artificial Sequence; identical to SEQ ID NO: 1441
  Synthetic Polypeptide

SEQ ID NO: 1610 - protein, 453 aa, Artificial Sequence; identical to SEQ ID NO: 1608
  Synthetic Polypeptide

SEQ ID NO: 1611 - protein, 215 aa, Artificial Sequence; identical to SEQ ID NO: 210
  Synthetic Polypeptide

SEQ ID NO: 1612 - protein, 453 aa, Artificial Sequence; identical to SEQ ID NO: 1326
  Synthetic Polypeptide

SEQ ID NO: 1613 - protein, 215 aa, Artificial Sequence; identical to SEQ ID NO: 210
  Synthetic Polypeptide

SEQ ID NO: 1614 - protein, 453 aa, Artificial Sequence; identical to SEQ ID NO: 1326
  Synthetic Polypeptide

SEQ ID NO: 1615 - protein, 215 aa, Artificial Sequence
  Synthetic Polypeptide
EIVLTQSPGTLSLSPGERATLSCRASRSVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1616 - protein, 453 aa, Artificial Sequence; identical to SEQ ID NO: 1338
  Synthetic Polypeptide

SEQ ID NO: 1617 - protein, 215 aa, Artificial Sequence; identical to SEQ ID NO: 1615
  Synthetic Polypeptide

SEQ ID NO: 1618 - protein, 453 aa, Artificial Sequence; identical to SEQ ID NO: 1338
  Synthetic Polypeptide

SEQ ID NO: 1619 - protein, 215 aa, Artificial Sequence; identical to SEQ ID NO: 1481
  Synthetic Polypeptide

SEQ ID NO: 1620 - protein, 453 aa, Artificial Sequence
  Synthetic Polypeptide
QVQLQESGPGLVKPSETLSLTCTVSGGHIPSGGYYWNWIRQPPGKGLEWIGYIYYSGSTFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1621 - protein, 215 aa, Artificial Sequence; identical to SEQ ID NO: 1481
  Synthetic Polypeptide

SEQ ID NO: 1622 - protein, 453 aa, Artificial Sequence; identical to SEQ ID NO: 1620
  Synthetic Polypeptide

SEQ ID NO: 1623 - protein, 215 aa, Artificial Sequence; identical to SEQ ID NO: 1509
  Synthetic Polypeptide

SEQ ID NO: 1624 - protein, 453 aa, Artificial Sequence
  Synthetic Polypeptide
QVQLQESGPGLVKPSETLSLTCTVSGGSFSRGGYYWNWIRQPPGKGLEWIGYIYYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1625 - protein, 215 aa, Artificial Sequence; identical to SEQ ID NO: 1509
  Synthetic Polypeptide

SEQ ID NO: 1626 - protein, 453 aa, Artificial Sequence; identical to SEQ ID NO: 1624
  Synthetic Polypeptide

SEQ ID NO: 1627 - protein, 215 aa, Artificial Sequence
  Synthetic Polypeptide
EIVLTQSPGTLSLSPGERATLSCRASQKVASAYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1628 - protein, 453 aa, Artificial Sequence
  Synthetic Polypeptide
QVQLQESGPGLVKPSETLSLTCTVSGGSISSGGYYWNWIRQPPGKGLEWIGYIQYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1629 - protein, 215 aa, Artificial Sequence; identical to SEQ ID NO: 1627
  Synthetic Polypeptide

SEQ ID NO: 1630 - protein, 453 aa, Artificial Sequence; identical to SEQ ID NO: 1628
  Synthetic Polypeptide

SEQ ID NO: 1631 - protein, 215 aa, Artificial Sequence
  Synthetic Polypeptide
EIVLTQSPGTLSLSPGERATLSCRASQLVASAYLAWYQQKPGQAPRLLFYGASSRATGIPDRFSRSGSGTDFTLTISRLEPEDFAVYYCQQYATVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1632 - protein, 453 aa, Artificial Sequence
  Synthetic Polypeptide
QVQLQESGPGLVKPSETLSLTCTVSGGSISSGGYYWNWIRQPPGKGLEWIGYIYGRGSTFYNPSLKSRVTISVDTSKNQFSLKLSSVTAADTAVYYCARAPRYNWDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1633 - protein, 215 aa, Artificial Sequence; identical to SEQ ID NO: 1631
  Synthetic Polypeptide

SEQ ID NO: 1634 - protein, 453 aa, Artificial Sequence; identical to SEQ ID NO: 1632
  Synthetic Polypeptide

SEQ ID NO: 1635 - protein, 215 aa, Artificial Sequence; identical to SEQ ID NO: 1445
  Synthetic Polypeptide

SEQ ID NO: 1636 - protein, 453 aa, Artificial Sequence; identical to SEQ ID NO: 1338
  Synthetic Polypeptide

SEQ ID NO: 1637 - protein, 215 aa, Artificial Sequence; identical to SEQ ID NO: 1445
  Synthetic Polypeptide

SEQ ID NO: 1638 - protein, 453 aa, Artificial Sequence; identical to SEQ ID NO: 1338
  Synthetic Polypeptide

SEQ ID NO: 1639 - protein, 215 aa, Artificial Sequence; identical to SEQ ID NO: 1317
  Synthetic Polypeptide

SEQ ID NO: 1640 - protein, 453 aa, Artificial Sequence
  Synthetic Polypeptide
QVQLQESGPGLVKPSETLSLTCTVSGGSISSGGYLWAWIRQPPGKGLEWIGYIYYSGSTFYNPSLKSRVTISVDTSKNQFSLKLSSVTAADTAVYYCARAPRYNFNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1641 - protein, 215 aa, Artificial Sequence; identical to SEQ ID NO: 1317
  Synthetic Polypeptide

SEQ ID NO: 1642 - protein, 453 aa, Artificial Sequence; identical to SEQ ID NO: 1640
  Synthetic Polypeptide

SEQ ID NO: 1643 - protein, 215 aa, Artificial Sequence; identical to SEQ ID NO: 1449
  Synthetic Polypeptide

SEQ ID NO: 1644 - protein, 453 aa, Artificial Sequence
  Synthetic Polypeptide
QVQLQESGPGLVKPSETLSLTCTVSGGSISSGGYYWNWIRQPPGKGLEWIGYTYPSGSTFYNPSLKSRVTISVDTSKNQFSLKLSSVTAADTAVYYCARAPRYNFNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1645 - protein, 215 aa, Artificial Sequence; identical to SEQ ID NO: 1449
  Synthetic Polypeptide

SEQ ID NO: 1646 - protein, 453 aa, Artificial Sequence; identical to SEQ ID NO: 1644
  Synthetic Polypeptide

SEQ ID NO: 1647 - protein, 215 aa, Artificial Sequence; identical to SEQ ID NO: 1509
  Synthetic Polypeptide

SEQ ID NO: 1648 - protein, 453 aa, Artificial Sequence
  Synthetic Polypeptide
QVQLQESGPGLVKPSETLSLTCTVSGGSISSGGYYWNWIRQPPGKGLEWIGYIYPKGSTFYNPSLKSRVTISVDTSKNQFSLKLSSVTAADTAVYYCARAPRYNFNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1649 - protein, 215 aa, Artificial Sequence; identical to SEQ ID NO: 1509
  Synthetic Polypeptide

SEQ ID NO: 1650 - protein, 453 aa, Artificial Sequence; identical to SEQ ID NO: 1648
  Synthetic Polypeptide

SEQ ID NO: 1651 - protein, 215 aa, Artificial Sequence; identical to SEQ ID NO: 1469
  Synthetic Polypeptide

SEQ ID NO: 1652 - protein, 453 aa, Artificial Sequence
  Synthetic Polypeptide
QVQLQESGPGLVKPSETLSLTCTVSGGSISSGGYYWNWIRQPPGKGLEWIGLIQYSGSTFYNPSLKSRVTISVDTSKNQFSLKLSSVTAADTAVYYCARAPRYNFNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1653 - protein, 215 aa, Artificial Sequence; identical to SEQ ID NO: 1469
  Synthetic Polypeptide

SEQ ID NO: 1654 - protein, 453 aa, Artificial Sequence; identical to SEQ ID NO: 1652
  Synthetic Polypeptide

SEQ ID NO: 1655 - protein, 215 aa, Artificial Sequence; identical to SEQ ID NO: 1321
  Synthetic Polypeptide

SEQ ID NO: 1656 - protein, 453 aa, Artificial Sequence
  Synthetic Polypeptide
QVQLQESGPGLVKPSETLSLTCTVSGGSISSGGYYWNWIRQPPGKGLEWIGYIQRSGSTFYNPSLKSRVTISVDTSKNQFSLKLSSVTAADTAVYYCARAPRYNFNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1657 - protein, 215 aa, Artificial Sequence; identical to SEQ ID NO: 1321
  Synthetic Polypeptide

SEQ ID NO: 1658 - protein, 453 aa, Artificial Sequence; identical to SEQ ID NO: 1656
  Synthetic Polypeptide

SEQ ID NO: 1659 - protein, 215 aa, Artificial Sequence; identical to SEQ ID NO: 210
  Synthetic Polypeptide

SEQ ID NO: 1660 - protein, 453 aa, Artificial Sequence
  Synthetic Polypeptide
QVQLQESGPGLVKPSETLSLTCTVSGGSISSGGYYWNWIRQPPGKGLEWIGYIQKSGSTFYNPSLKSRVTISVDTSKNQFSLKLSSVTAADTAVYYCARAPRYNFNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1661 - protein, 215 aa, Artificial Sequence; identical to SEQ ID NO: 210
  Synthetic Polypeptide

SEQ ID NO: 1662 - protein, 453 aa, Artificial Sequence; identical to SEQ ID NO: 1660
  Synthetic Polypeptide

SEQ ID NO: 1663 - protein, 215 aa, Artificial Sequence; identical to SEQ ID NO: 1485
  Synthetic Polypeptide

SEQ ID NO: 1664 - protein, 453 aa, Artificial Sequence
  Synthetic Polypeptide
QVQLQESGPGLVKPSETLSLTCTVSGGSISSGGYYWNWIRQPPGKGLEWIGYIYKSGSTFYNPSLKSRVTISVDTSKNQFSLKLSSVTAADTAVYYCARAPRYNFDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1665 - protein, 215 aa, Artificial Sequence; identical to SEQ ID NO: 1485
  Synthetic Polypeptide

SEQ ID NO: 1666 - protein, 453 aa, Artificial Sequence; identical to SEQ ID NO: 1664
  Synthetic Polypeptide

SEQ ID NO: 1667 - protein, 215 aa, Artificial Sequence; identical to SEQ ID NO: 1357
  Synthetic Polypeptide

SEQ ID NO: 1668 - protein, 453 aa, Artificial Sequence
  Synthetic Polypeptide
QVQLQESGPGLVKPSETLSLTCTVSGGSISSGGYYWNWIRQPPGKGLEWIGYIQASGSTFYNPSLKSRVTISVDTSKNQFSLKLSSVTAADTAVYYCARAPRYNFNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1669 - protein, 215 aa, Artificial Sequence; identical to SEQ ID NO: 1357
  Synthetic Polypeptide

SEQ ID NO: 1670 - protein, 453 aa, Artificial Sequence; identical to SEQ ID NO: 1668
  Synthetic Polypeptide

SEQ ID NO: 1671 - protein, 215 aa, Artificial Sequence; identical to SEQ ID NO: 1389
  Synthetic Polypeptide

SEQ ID NO: 1672 - protein, 453 aa, Artificial Sequence; identical to SEQ ID NO: 1656
  Synthetic Polypeptide

SEQ ID NO: 1673 - protein, 215 aa, Artificial Sequence; identical to SEQ ID NO: 1389
  Synthetic Polypeptide

SEQ ID NO: 1674 - protein, 453 aa, Artificial Sequence; identical to SEQ ID NO: 1656
  Synthetic Polypeptide

SEQ ID NO: 1675 - protein, 215 aa, Artificial Sequence; identical to SEQ ID NO: 1313
  Synthetic Polypeptide

SEQ ID NO: 1676 - protein, 453 aa, Artificial Sequence
  Synthetic Polypeptide
QVQLQESGPGLVKPSETLSLTCTVSGGSIPSQGYYWNWIRQPPGKGLEWIGLIQYSGSTFYNPSLKSRVTISVDTSKNQFSLKLSSVTAADTAVYYCARAPRYNFNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1677 - protein, 215 aa, Artificial Sequence; identical to SEQ ID NO: 1313
  Synthetic Polypeptide

SEQ ID NO: 1678 - protein, 453 aa, Artificial Sequence; identical to SEQ ID NO: 1676
  Synthetic Polypeptide

SEQ ID NO: 1679 - protein, 215 aa, Artificial Sequence; identical to SEQ ID NO: 1405
  Synthetic Polypeptide

SEQ ID NO: 1680 - protein, 453 aa, Artificial Sequence
  Synthetic Polypeptide
QVQLQESGPGLVKPSETLSLTCTVSGGSISSGGLLWNWIRQPPGKGLEWIGYIYYSGSTFYNPSLKSRVTISVDTSKNQFSLKLSSVTAADTAVYYCARAPRYNHDYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1681 - protein, 215 aa, Artificial Sequence; identical to SEQ ID NO: 1405
  Synthetic Polypeptide

SEQ ID NO: 1682 - protein, 453 aa, Artificial Sequence; identical to SEQ ID NO: 1680
  Synthetic Polypeptide

SEQ ID NO: 1683 - protein, 215 aa, Artificial Sequence
  Synthetic Polypeptide
EIVLTQSPGTLSLSPGERATLSCRASQLVASVYLAWYQQKPGQAPRLLFYGASSRATGIPDRFSGSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1684 - protein, 453 aa, Artificial Sequence; identical to SEQ ID NO: 1318
  Synthetic Polypeptide

SEQ ID NO: 1685 - protein, 215 aa, Artificial Sequence; identical to SEQ ID NO: 1683
  Synthetic Polypeptide

SEQ ID NO: 1686 - protein, 453 aa, Artificial Sequence; identical to SEQ ID NO: 1318
  Synthetic Polypeptide

SEQ ID NO: 1687 - protein, 215 aa, Artificial Sequence
  Synthetic Polypeptide
EIVLTQSPGTLSLSPGERATLSCRASQKVASTYLAWYQQKPGQAPRLLFYGASSRATGIPDRFSGSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1688 - protein, 453 aa, Artificial Sequence; identical to SEQ ID NO: 1422
  Synthetic Polypeptide

SEQ ID NO: 1689 - protein, 215 aa, Artificial Sequence; identical to SEQ ID NO: 1687
  Synthetic Polypeptide

SEQ ID NO: 1690 - protein, 453 aa, Artificial Sequence; identical to SEQ ID NO: 1422
  Synthetic Polypeptide

SEQ ID NO: 1691 - protein, 215 aa, Artificial Sequence
  Synthetic Polypeptide
EIVLTQSPGTLSLSPGERATLSCRASRNVSSTYLAWYQQKPGQAPRLLFYGASSRATGIPDRFSGSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1692 - protein, 453 aa, Artificial Sequence; identical to SEQ ID NO: 1604
  Synthetic Polypeptide

SEQ ID NO: 1693 - protein, 215 aa, Artificial Sequence; identical to SEQ ID NO: 1691
  Synthetic Polypeptide

SEQ ID NO: 1694 - protein, 453 aa, Artificial Sequence; identical to SEQ ID NO: 1604
  Synthetic Polypeptide

SEQ ID NO: 1695 - protein, 215 aa, Artificial Sequence
  Synthetic Polypeptide
EIVLTQSPGTLSLSPGERATLSCRASQNVASPYLAWYQQKPGQAPRLLFYGASSRATGIPDRFSGSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1696 - protein, 453 aa, Artificial Sequence; identical to SEQ ID NO: 1326
  Synthetic Polypeptide

SEQ ID NO: 1697 - protein, 215 aa, Artificial Sequence; identical to SEQ ID NO: 1695
  Synthetic Polypeptide

SEQ ID NO: 1698 - protein, 453 aa, Artificial Sequence; identical to SEQ ID NO: 1326
  Synthetic Polypeptide

SEQ ID NO: 1699 - protein, 215 aa, Artificial Sequence
  Synthetic Polypeptide
EIVLTQSPGTLSLSPGERATLSCRASQLVSSTYLAWYQQKPGQAPRLLFYGASSRATGIPDRFSGSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1700 - protein, 453 aa, Artificial Sequence; identical to SEQ ID NO: 1326
  Synthetic Polypeptide

SEQ ID NO: 1701 - protein, 215 aa, Artificial Sequence; identical to SEQ ID NO: 1699
  Synthetic Polypeptide

SEQ ID NO: 1702 - protein, 453 aa, Artificial Sequence; identical to SEQ ID NO: 1326
  Synthetic Polypeptide

SEQ ID NO: 1703 - protein, 215 aa, Artificial Sequence
  Synthetic Polypeptide
EIVLTQSPGTLSLSPGERATLSCRASQNVASAYLAWYQQKPGQAPRLLFYGASSRATGIPDRFSGSGSGTDFTLTISRLEPEDFAVYYCQQYDVVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1704 - protein, 453 aa, Artificial Sequence; identical to SEQ ID NO: 1418
  Synthetic Polypeptide

SEQ ID NO: 1705 - protein, 215 aa, Artificial Sequence; identical to SEQ ID NO: 1703
  Synthetic Polypeptide

SEQ ID NO: 1706 - protein, 453 aa, Artificial Sequence; identical to SEQ ID NO: 1418
  Synthetic Polypeptide

SEQ ID NO: 1707 - protein, 215 aa, Artificial Sequence
  Synthetic Polypeptide
EIVLTQSPGTLSLSPGERATLSCRASQPVASLYLAWYQQKPGQAPRLLFYGASSRATGIPDRFSGSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1708 - protein, 453 aa, Artificial Sequence; identical to SEQ ID NO: 1322
  Synthetic Polypeptide

SEQ ID NO: 1709 - protein, 215 aa, Artificial Sequence; identical to SEQ ID NO: 1707
  Synthetic Polypeptide

SEQ ID NO: 1710 - protein, 453 aa, Artificial Sequence; identical to SEQ ID NO: 1322
  Synthetic Polypeptide

SEQ ID NO: 1711 - protein, 215 aa, Artificial Sequence
  Synthetic Polypeptide
EIVLTQSPGTLSLSPGERATLSCRASQQVSSTYLAWYQQKPGQAPRLLFYGASSRATGIPDRFSGSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1712 - protein, 453 aa, Artificial Sequence; identical to SEQ ID NO: 1374
  Synthetic Polypeptide

SEQ ID NO: 1713 - protein, 215 aa, Artificial Sequence; identical to SEQ ID NO: 1711
  Synthetic Polypeptide

SEQ ID NO: 1714 - protein, 453 aa, Artificial Sequence; identical to SEQ ID NO: 1374
  Synthetic Polypeptide

SEQ ID NO: 1715 - protein, 215 aa, Artificial Sequence
  Synthetic Polypeptide
EIVLTQSPGTLSLSPGERATLSCRASQAVASVYLAWYQQKPGQAPRLLFYLAHSRATGIPDRFSGSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1716 - protein, 453 aa, Artificial Sequence; identical to SEQ ID NO: 1584
  Synthetic Polypeptide

SEQ ID NO: 1717 - protein, 215 aa, Artificial Sequence; identical to SEQ ID NO: 1715
  Synthetic Polypeptide

SEQ ID NO: 1718 - protein, 453 aa, Artificial Sequence; identical to SEQ ID NO: 1584
  Synthetic Polypeptide

SEQ ID NO: 1719 - protein, 215 aa, Artificial Sequence
  Synthetic Polypeptide
EIVLTQSPGTLSLSPGERATLSCRASQQVSSTYLAWYQQKPGQAPRLLFYLHSSRATGIPDRFSGSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1720 - protein, 453 aa, Artificial Sequence; identical to SEQ ID NO: 1410
  Synthetic Polypeptide

SEQ ID NO: 1721 - protein, 215 aa, Artificial Sequence; identical to SEQ ID NO: 1719
  Synthetic Polypeptide

SEQ ID NO: 1722 - protein, 453 aa, Artificial Sequence; identical to SEQ ID NO: 1410
  Synthetic Polypeptide

SEQ ID NO: 1723 - protein, 215 aa, Artificial Sequence
  Synthetic Polypeptide
EIVLTQSPGTLSLSPGERATLSCRASQQVASVYLAWYQQKPGQAPRLLFYGASSRATGIPDRFSGSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1724 - protein, 453 aa, Artificial Sequence; identical to SEQ ID NO: 1350
  Synthetic Polypeptide

SEQ ID NO: 1725 - protein, 215 aa, Artificial Sequence; identical to SEQ ID NO: 1723
  Synthetic Polypeptide

SEQ ID NO: 1726 - protein, 453 aa, Artificial Sequence; identical to SEQ ID NO: 1350
  Synthetic Polypeptide

SEQ ID NO: 1727 - protein, 215 aa, Artificial Sequence
  Synthetic Polypeptide
EIVLTQSPGTLSLSPGERATLSCISSQQVSSTYLAWYQQKPGQAPRLLFYGALARATGIPDRFSGSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1728 - protein, 453 aa, Artificial Sequence; identical to SEQ ID NO: 1374
  Synthetic Polypeptide

SEQ ID NO: 1729 - protein, 215 aa, Artificial Sequence; identical to SEQ ID NO: 1727
  Synthetic Polypeptide

SEQ ID NO: 1730 - protein, 453 aa, Artificial Sequence; identical to SEQ ID NO: 1374
  Synthetic Polypeptide

SEQ ID NO: 1731 - protein, 215 aa, Artificial Sequence
  Synthetic Polypeptide
EIVLTQSPGTLSLSPGERATLSCRASQLVSSVYLAWYQQKPGQAPRLLFYGASSRATGIPDRFSGSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1732 - protein, 453 aa, Artificial Sequence; identical to SEQ ID NO: 1338
  Synthetic Polypeptide

SEQ ID NO: 1733 - protein, 215 aa, Artificial Sequence; identical to SEQ ID NO: 1731
  Synthetic Polypeptide

SEQ ID NO: 1734 - protein, 453 aa, Artificial Sequence; identical to SEQ ID NO: 1338
  Synthetic Polypeptide

SEQ ID NO: 1735 - protein, 214 aa, Artificial Sequence
  Synthetic Polypeptide
DIQMTQSPSSLSASVGDRVTITCRSSQSISSYLNWYQQKPGRAPKLLIHAASSLQSGVPSRFSGSGSGTDFTLTISSLQPEDFASYYCQQSYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1736 - protein, 450 aa, Artificial Sequence; identical to SEQ ID NO: 169
  Synthetic Polypeptide

SEQ ID NO: 1737 - protein, 215 aa, Artificial Sequence
  Synthetic Polypeptide
EIVLTQSPGTLSLSPGERATLSCRASQSVSSTYLAWYQQKPGQAPRLLFYGASSRATGIPDRFSRSGSGTDFTLTISRLEPEDFAVYYCQQYDVSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1738 - protein, 453 aa, Artificial Sequence
  Synthetic Polypeptide
QVQLQESGPGLVKPSQTLSLTCTVSGGSISSGGYYWNWIRQHPGKGLEWIGYIYYSGSTFYNPSLKSRVIISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1739 - protein, 215 aa, Artificial Sequence; identical to SEQ ID NO: 210
  Synthetic Polypeptide

SEQ ID NO: 1740 - protein, 453 aa, Artificial Sequence; identical to SEQ ID NO: 1738
  Synthetic Polypeptide

SEQ ID NO: 1741 - protein, 214 aa, Artificial Sequence
  Synthetic Polypeptide
DIQMTQSPSSLSASVGDRVTITCRASQNIRRYLNWYQQKPGKAPKLLIYSASNLQNGVPSRFSGSGSGTDFTLTISSLQPEDFATYYCQQSYIIPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1742 - protein, 452 aa, Artificial Sequence; identical to SEQ ID NO: 139
  Synthetic Polypeptide

SEQ ID NO: 1743 - protein, 214 aa, Artificial Sequence
  Synthetic Polypeptide
DIQMTQSPSSLSASVGDRVTITCRASQNIRRYLNWYQQKPGKAPELLIYSASNLQSGVPSRFSGSGSGTDFTLTISSLQPEDFATYYCQQSYIIPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1744 - protein, 452 aa, Artificial Sequence; identical to SEQ ID NO: 139
  Synthetic Polypeptide

SEQ ID NO: 1745 - protein, 214 aa, Artificial Sequence
  Synthetic Polypeptide
DIQMTQSPSSLSASVGDRVTITCRASQNIRRYLNWYQQKPGKAPELLIYSASNLQNAVPSRFSGSGSGTDFTLTISSLQPEDFATYYCQQSYIIPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1746 - protein, 452 aa, Artificial Sequence; identical to SEQ ID NO: 139
  Synthetic Polypeptide

SEQ ID NO: 1747 - protein, 214 aa, Artificial Sequence; identical to SEQ ID NO: 140
  Synthetic Polypeptide

SEQ ID NO: 1748 - protein, 452 aa, Artificial Sequence
  Synthetic Polypeptide
QVQLVQSGAEVKKPGASVKVSCKASGYTFTSYYIHWVRQAPGQGLEWMGIINPSGGRTSYAQMFQGRVTLTRDTSTNTVYMELSSLRSEDTAVFYCAKDREEQYPVGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1749 - protein, 214 aa, Artificial Sequence; identical to SEQ ID NO: 140
  Synthetic Polypeptide

SEQ ID NO: 1750 - protein, 452 aa, Artificial Sequence
  Synthetic Polypeptide
QVQLVQSGAEVKKPGASVKVSCKASGYTFTSYYIHWVRQAPGQGLEWMGIINPSGGRTSYAQMFQGRVTLTRDTSTNTVYMELSSLRSEDTAVFYCAKDREEQFPVGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1751 - protein, 214 aa, Artificial Sequence
  Synthetic Polypeptide
DIQMTQSPSSLSASVGDRVTITCRASQNIRRYLNWYQQKPGKAPKLLIYSASNLQSGVPSRFSGSGSGTDFTLTISSLQPEDFATYYCQQSYIIPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1752 - protein, 452 aa, Artificial Sequence; identical to SEQ ID NO: 139
  Synthetic Polypeptide

SEQ ID NO: 1753 - protein, 214 aa, Artificial Sequence
  Synthetic Polypeptide
DIQMTQSPSSLSASVGDRVTITCRASQNIRRYLNWYQQKPGKAPKLLIYSASNLQNAVPSRFSGSGSGTDFTLTISSLQPEDFATYYCQQSYIIPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1754 - protein, 452 aa, Artificial Sequence; identical to SEQ ID NO: 139
  Synthetic Polypeptide

SEQ ID NO: 1755 - protein, 214 aa, Artificial Sequence; identical to SEQ ID NO: 1741
  Synthetic Polypeptide

SEQ ID NO: 1756 - protein, 452 aa, Artificial Sequence; identical to SEQ ID NO: 1748
  Synthetic Polypeptide

SEQ ID NO: 1757 - protein, 214 aa, Artificial Sequence; identical to SEQ ID NO: 1741
  Synthetic Polypeptide

SEQ ID NO: 1758 - protein, 452 aa, Artificial Sequence; identical to SEQ ID NO: 1750
  Synthetic Polypeptide

SEQ ID NO: 1759 - protein, 214 aa, Artificial Sequence; identical to SEQ ID NO: 1743
  Synthetic Polypeptide

SEQ ID NO: 1760 - protein, 452 aa, Artificial Sequence; identical to SEQ ID NO: 1750
  Synthetic Polypeptide

SEQ ID NO: 1761 - protein, 214 aa, Artificial Sequence; identical to SEQ ID NO: 1745
  Synthetic Polypeptide

SEQ ID NO: 1762 - protein, 452 aa, Artificial Sequence; identical to SEQ ID NO: 1750
  Synthetic Polypeptide

SEQ ID NO: 1763 - protein, 214 aa, Artificial Sequence; identical to SEQ ID NO: 1751
  Synthetic Polypeptide

SEQ ID NO: 1764 - protein, 452 aa, Artificial Sequence; identical to SEQ ID NO: 1750
  Synthetic Polypeptide

SEQ ID NO: 1765 - protein, 214 aa, Artificial Sequence; identical to SEQ ID NO: 1753
  Synthetic Polypeptide

SEQ ID NO: 1766 - protein, 452 aa, Artificial Sequence; identical to SEQ ID NO: 1750
  Synthetic Polypeptide

SEQ ID NO: 1767 - protein, 214 aa, Artificial Sequence
  Synthetic Polypeptide
DIQMTQSPSSLSASVGDRVTITCRASQSIRRYLNWYQQKPGKAPKFLIYDASSLQSGVPSRFSGSGSGTDFTLTISSLQPEDFATYYCQQSYSTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1768 - protein, 453 aa, Artificial Sequence; identical to SEQ ID NO: 149
  Synthetic Polypeptide

SEQ ID NO: 1769 - protein, 214 aa, Artificial Sequence
  Synthetic Polypeptide
DIQMTQSPSSLSASVGDRVTITCRASQSIRRYLNWYQQIPGKAPKLLIYDASSLQSGVPSRFSGSGSGTDFTLTISSLQPEDFATYYCQQSYSTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1770 - protein, 453 aa, Artificial Sequence; identical to SEQ ID NO: 149
  Synthetic Polypeptide

SEQ ID NO: 1771 - protein, 214 aa, Artificial Sequence; identical to SEQ ID NO: 150
  Synthetic Polypeptide

SEQ ID NO: 1772 - protein, 453 aa, Artificial Sequence
  Synthetic Polypeptide
QVQLQESGPGLVKPSETLSLTCTVSGGSVTNYYWSWIRQPAGKGLEWIGRIYTSGSTYYNPSLKSRVTMSLDTSKNQFSLRLSSVTAADTAVYYCAREGFTMVRGVMGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1773 - protein, 214 aa, Artificial Sequence
  Synthetic Polypeptide
DIQMTQSPSSLSASVGDRVTITCRASQSIRRYLNWYQQKPGKAPKLLIYDASSLQSGVPSRFSGSGSGTDFTLTISSLQPEDFATYYCQQSYSTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1774 - protein, 453 aa, Artificial Sequence; identical to SEQ ID NO: 149
  Synthetic Polypeptide

SEQ ID NO: 1775 - protein, 214 aa, Artificial Sequence; identical to SEQ ID NO: 1767
  Synthetic Polypeptide

SEQ ID NO: 1776 - protein, 453 aa, Artificial Sequence; identical to SEQ ID NO: 1772
  Synthetic Polypeptide

SEQ ID NO: 1777 - protein, 214 aa, Artificial Sequence; identical to SEQ ID NO: 1769
  Synthetic Polypeptide

SEQ ID NO: 1778 - protein, 453 aa, Artificial Sequence; identical to SEQ ID NO: 1772
  Synthetic Polypeptide

SEQ ID NO: 1779 - protein, 214 aa, Artificial Sequence; identical to SEQ ID NO: 1773
  Synthetic Polypeptide

SEQ ID NO: 1780 - protein, 453 aa, Artificial Sequence; identical to SEQ ID NO: 1772
  Synthetic Polypeptide

SEQ ID NO: 1781 - protein, 214 aa, Artificial Sequence
  Synthetic Polypeptide
DIEMTQAPSSLSASVGDRVTITCRASQTIRRYLNWYQQKPGKAPKLLIYAASSLQSGVPSRFSGSVSGTDFTLTISSLQPEDFATYYCQQSYSTPLTFGGGTKVGIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1782 - protein, 452 aa, Artificial Sequence; identical to SEQ ID NO: 159
  Synthetic Polypeptide

SEQ ID NO: 1783 - protein, 214 aa, Artificial Sequence
  Synthetic Polypeptide
DIEMTQAPSSLSASVGDRVTITCRASQTIRRYLNWYQQKPGKAPKLLIYAASSLQNAVPSRFSGSVSGTDFTLTISSLQPEDFATYYCQQSYSTPLTFGGGTKVGIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1784 - protein, 452 aa, Artificial Sequence; identical to SEQ ID NO: 159
  Synthetic Polypeptide

SEQ ID NO: 1785 - protein, 214 aa, Artificial Sequence; identical to SEQ ID NO: 160
  Synthetic Polypeptide

SEQ ID NO: 1786 - protein, 452 aa, Artificial Sequence
  Synthetic Polypeptide
QVQLVQSGAEVKKPGASVKVSCKASGYTFTGYYIHWVRQAPGQGLEWMGWISPTSGATGYAQNFQGRVTMTRDTSITTAYMELSRLRSDDTAVYYCARDANSVLYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1787 - protein, 214 aa, Artificial Sequence; identical to SEQ ID NO: 1781
  Synthetic Polypeptide

SEQ ID NO: 1788 - protein, 452 aa, Artificial Sequence; identical to SEQ ID NO: 1786
  Synthetic Polypeptide

SEQ ID NO: 1789 - protein, 214 aa, Artificial Sequence; identical to SEQ ID NO: 1783
  Synthetic Polypeptide

SEQ ID NO: 1790 - protein, 452 aa, Artificial Sequence; identical to SEQ ID NO: 1786
  Synthetic Polypeptide

SEQ ID NO: 1791 - protein, 214 aa, Artificial Sequence
  Synthetic Polypeptide
DIEMTQSPSSLSASVGDRVTITCRASQTIRRYLNWYQQKPGKAPKLLIYAASSLQNGVPSRFSGSVSGTDFTLTISSLQPEDFATYYCQQSYSTPLTFGGGTKVGIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1792 - protein, 452 aa, Artificial Sequence; identical to SEQ ID NO: 159
  Synthetic Polypeptide

SEQ ID NO: 1793 - protein, 214 aa, Artificial Sequence
  Synthetic Polypeptide
DIEMTQSPSSLSASVGDRVTITCRASQTIRRYLNWYQQKPGKAPKLLIYAASSLQSGVPSRFSGSVSGTDFTLTISSLQPEDFATYYCQQSYSTPLTFGGGTKVGIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1794 - protein, 452 aa, Artificial Sequence; identical to SEQ ID NO: 159
  Synthetic Polypeptide

SEQ ID NO: 1795 - protein, 214 aa, Artificial Sequence; identical to SEQ ID NO: 1791
  Synthetic Polypeptide

SEQ ID NO: 1796 - protein, 452 aa, Artificial Sequence; identical to SEQ ID NO: 1786
  Synthetic Polypeptide

SEQ ID NO: 1797 - protein, 214 aa, Artificial Sequence; identical to SEQ ID NO: 1793
  Synthetic Polypeptide

SEQ ID NO: 1798 - protein, 452 aa, Artificial Sequence; identical to SEQ ID NO: 1786
  Synthetic Polypeptide

SEQ ID NO: 1799 - protein, 214 aa, Artificial Sequence
  Synthetic Polypeptide
DIEMTQSPSSLSASVGDRVTITCRASQTIRRYLNWYQQKPGKAPKLLIYAASSLQNAVPSRFSGSVSGTDFTLTISSLQPEDFATYYCQQSYSTPLTFGGGTKVGIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1800 - protein, 452 aa, Artificial Sequence; identical to SEQ ID NO: 1786
  Synthetic Polypeptide

SEQ ID NO: 1801 - protein, 214 aa, Artificial Sequence
  Synthetic Polypeptide
DIEMTQSPSSLSASVGDRVTITCRASQTIRRYLNWYQQKPGKAPKLLIYAASSLQSGVPSRFSGSGSGTDFTLTISSLQPEDFATYYCQQSYSTPLTFGGGTKVGIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1802 - protein, 452 aa, Artificial Sequence; identical to SEQ ID NO: 159
  Synthetic Polypeptide

SEQ ID NO: 1803 - protein, 214 aa, Artificial Sequence; identical to SEQ ID NO: 1801
  Synthetic Polypeptide

SEQ ID NO: 1804 - protein, 452 aa, Artificial Sequence; identical to SEQ ID NO: 1786
  Synthetic Polypeptide

SEQ ID NO: 1805 - protein, 214 aa, Artificial Sequence
  Synthetic Polypeptide
DIEMTQSPSSLSASVGDRVTITCRASQTIRRYLNWYQQKPGKAPKLLIYAASSLQNGVPSRFSGSGSGTDFTLTISSLQPEDFATYYCQQSYSTPLTFGGGTKVGIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1806 - protein, 452 aa, Artificial Sequence; identical to SEQ ID NO: 1786
  Synthetic Polypeptide

SEQ ID NO: 1807 - protein, 214 aa, Artificial Sequence
  Synthetic Polypeptide
DIEMTQSPSSLSASVGDRVTITCRASQTIRRYLNWYQQKPGKAPKLLIYAASSLQNAVPSRFSGSGSGTDFTLTISSLQPEDFATYYCQQSYSTPLTFGGGTKVGIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1808 - protein, 452 aa, Artificial Sequence; identical to SEQ ID NO: 159
  Synthetic Polypeptide

SEQ ID NO: 1809 - protein, 214 aa, Artificial Sequence; identical to SEQ ID NO: 1807
  Synthetic Polypeptide

SEQ ID NO: 1810 - protein, 452 aa, Artificial Sequence; identical to SEQ ID NO: 1786
  Synthetic Polypeptide

SEQ ID NO: 1811 - protein, 214 aa, Artificial Sequence
  Synthetic Polypeptide
DIEMTQSPSSLSASVGDRVTITCRASQTIRRYLNWYQQKPGKAPKLLIYAASSLQSGVPSRFSGSGSGTDFTLTISSLQPEDFATYYCQQSYSTPLTFGGGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1812 - protein, 452 aa, Artificial Sequence; identical to SEQ ID NO: 159
  Synthetic Polypeptide

SEQ ID NO: 1813 - protein, 214 aa, Artificial Sequence
  Synthetic Polypeptide
DIEMTQSPSSLSASVGDRVTITCRASQTIRRYLNWYQQKPGKAPKLLIYAASSLQNGVPSRFSGSGSGTDFTLTISSLQPEDFATYYCQQSYSTPLTFGGGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1814 - protein, 452 aa, Artificial Sequence; identical to SEQ ID NO: 1786
  Synthetic Polypeptide

SEQ ID NO: 1815 - protein, 214 aa, Artificial Sequence; identical to SEQ ID NO: 1811
  Synthetic Polypeptide

SEQ ID NO: 1816 - protein, 452 aa, Artificial Sequence; identical to SEQ ID NO: 1786
  Synthetic Polypeptide

SEQ ID NO: 1817 - protein, 214 aa, Artificial Sequence; identical to SEQ ID NO: 1811
  Synthetic Polypeptide

SEQ ID NO: 1818 - protein, 452 aa, Artificial Sequence
  Synthetic Polypeptide
QVQLVQSGAEVKKPGASVKVSCKASGYTFTGYYIHWVRQAPGQGLEWMGWISPTSGATGYAQNFQGRVTMTRDTSITTAYMELSSLRSDDTAVYYCARDANSVLYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1819 - protein, 214 aa, Artificial Sequence
  Synthetic Polypeptide
DIEMTQSPSSLSASVGDRVTITCRASQTIRRYLNWYQQKPGKAPKLLIYAASSLQSGVPSRFSGSVSGTDFTLTISSLQPEDFATYYCQQSYSTPLTFGGGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1820 - protein, 452 aa, Artificial Sequence; identical to SEQ ID NO: 1818
  Synthetic Polypeptide

SEQ ID NO: 1821 - protein, 214 aa, Artificial Sequence
  Synthetic Polypeptide
DIEMTQSPSSLSASVGDRVTITCRASQTIRRYLNWYQQKPGKAPKLLIYAASSLQNAVPSRFSGSGSGTDFTLTISSLQPEDFATYYCQQSYSTPLTFGGGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1822 - protein, 452 aa, Artificial Sequence; identical to SEQ ID NO: 1818
  Synthetic Polypeptide

SEQ ID NO: 1823 - protein, 214 aa, Artificial Sequence
  Synthetic Polypeptide
DIEMTQAPSSLSASVGDRVTITCRASQTIRRYLNWYQQKPGKAPKLLIYAASSLQSGVPSRFSGSVSGTDFTLTISSLQPEDFATYYCQQSYSTPLTFGGGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1824 - protein, 452 aa, Artificial Sequence; identical to SEQ ID NO: 1818
  Synthetic Polypeptide

SEQ ID NO: 1825 - protein, 214 aa, Artificial Sequence; identical to SEQ ID NO: 200
  Synthetic Polypeptide

SEQ ID NO: 1826 - protein, 450 aa, Artificial Sequence; identical to SEQ ID NO: 169
  Synthetic Polypeptide

SEQ ID NO: 1827 - protein, 214 aa, Artificial Sequence; identical to SEQ ID NO: 1735
  Synthetic Polypeptide

SEQ ID NO: 1828 - protein, 450 aa, Artificial Sequence
  Synthetic Polypeptide
QVQLQESGPGLVKPSETLSLTCTVSGGSISSGGYYWSWIRQHPGKGLEWIGYIYYRGGTYYNPSLRSRVTMSVDTSKNQFSLMLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1829 - protein, 214 aa, Artificial Sequence; identical to SEQ ID NO: 1735
  Synthetic Polypeptide

SEQ ID NO: 1830 - protein, 450 aa, Artificial Sequence
  Synthetic Polypeptide
QVQLQESGPGLVKPSQTLSLTCTVSGGSISSGGYYWSWIRQPPGKGLEWIGYIYYRGGTYYNPSLRSRVTMSVDTSKNQFSLMLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1831 - protein, 214 aa, Artificial Sequence; identical to SEQ ID NO: 1735
  Synthetic Polypeptide

SEQ ID NO: 1832 - protein, 450 aa, Artificial Sequence
  Synthetic Polypeptide
QVQLQESGPGLVKPSQTLSLTCTVSGGSISSGGYYWSWIRQHPGKGLEWIGYIYYRGGTYYNPSLRSRVTMSVDTSKNQFSLKLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1833 - protein, 214 aa, Artificial Sequence; identical to SEQ ID NO: 1735
  Synthetic Polypeptide

SEQ ID NO: 1834 - protein, 450 aa, Artificial Sequence
  Synthetic Polypeptide
QVQLQESGPGLVKPSQTLSLTCTVSGGSISSGGYYWSWIRQHPGKGLEWIGYIYYRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1835 - protein, 214 aa, Artificial Sequence; identical to SEQ ID NO: 200
  Synthetic Polypeptide

SEQ ID NO: 1836 - protein, 450 aa, Artificial Sequence; identical to SEQ ID NO: 1828
  Synthetic Polypeptide

SEQ ID NO: 1837 - protein, 214 aa, Artificial Sequence; identical to SEQ ID NO: 200
  Synthetic Polypeptide

SEQ ID NO: 1838 - protein, 450 aa, Artificial Sequence; identical to SEQ ID NO: 1830
  Synthetic Polypeptide

SEQ ID NO: 1839 - protein, 214 aa, Artificial Sequence; identical to SEQ ID NO: 200
  Synthetic Polypeptide

SEQ ID NO: 1840 - protein, 450 aa, Artificial Sequence; identical to SEQ ID NO: 1832
  Synthetic Polypeptide

SEQ ID NO: 1841 - protein, 214 aa, Artificial Sequence; identical to SEQ ID NO: 1735
  Synthetic Polypeptide

SEQ ID NO: 1842 - protein, 450 aa, Artificial Sequence
  Synthetic Polypeptide
QVQLQESGPGLVKPSETLSLTCTVSGGSISSGGYYWSWIRQPPGKGLEWIGYIYYRGGTYYNPSLRSRVTMSVDTSKNQFSLMLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1843 - protein, 214 aa, Artificial Sequence; identical to SEQ ID NO: 1735
  Synthetic Polypeptide

SEQ ID NO: 1844 - protein, 450 aa, Artificial Sequence
  Synthetic Polypeptide
QVQLQESGPGLVKPSETLSLTCTVSGGSISSGGYYWSWIRQHPGKGLEWIGYIYYRGGTYYNPSLRSRVTMSVDTSKNQFSLKLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1845 - protein, 214 aa, Artificial Sequence; identical to SEQ ID NO: 1735
  Synthetic Polypeptide

SEQ ID NO: 1846 - protein, 450 aa, Artificial Sequence; identical to SEQ ID NO: 199
  Synthetic Polypeptide

SEQ ID NO: 1847 - protein, 214 aa, Artificial Sequence; identical to SEQ ID NO: 1735
  Synthetic Polypeptide

SEQ ID NO: 1848 - protein, 450 aa, Artificial Sequence
  Synthetic Polypeptide
QVQLQESGPGLVKPSQTLSLTCTVSGGSISSGGYYWSWIRQPPGKGLEWIGYIYYRGGTYYNPSLRSRVTMSVDTSKNQFSLKLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1849 - protein, 214 aa, Artificial Sequence; identical to SEQ ID NO: 200
  Synthetic Polypeptide

SEQ ID NO: 1850 - protein, 450 aa, Artificial Sequence; identical to SEQ ID NO: 1842
  Synthetic Polypeptide

SEQ ID NO: 1851 - protein, 214 aa, Artificial Sequence; identical to SEQ ID NO: 200
  Synthetic Polypeptide

SEQ ID NO: 1852 - protein, 450 aa, Artificial Sequence; identical to SEQ ID NO: 1844
  Synthetic Polypeptide

SEQ ID NO: 1853 - protein, 214 aa, Artificial Sequence; identical to SEQ ID NO: 200
  Synthetic Polypeptide

SEQ ID NO: 1854 - protein, 450 aa, Artificial Sequence; identical to SEQ ID NO: 1848
  Synthetic Polypeptide

SEQ ID NO: 1855 - protein, 214 aa, Artificial Sequence; identical to SEQ ID NO: 1735
  Synthetic Polypeptide

SEQ ID NO: 1856 - protein, 450 aa, Artificial Sequence
  Synthetic Polypeptide
QVQLQESGPGLVKPSETLSLTCTVSGGSISSGGYYWSWIRQPPGKGLEWIGYIYYRGGTYYNPSLRSRVTMSVDTSKNQFSLKLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1857 - protein, 214 aa, Artificial Sequence; identical to SEQ ID NO: 1735
  Synthetic Polypeptide

SEQ ID NO: 1858 - protein, 450 aa, Artificial Sequence
  Synthetic Polypeptide
QVQLQESGPGLVKPSETLSLTCTVSGGSISSGGYYWSWIRQPPGKGLEWIGYIYYRGGTYYNPSLRSRVTMSVDTSKNQFSLRLSSVTAADTAVYYCARTIFGVIILDNWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1859 - protein, 214 aa, Artificial Sequence; identical to SEQ ID NO: 200
  Synthetic Polypeptide

SEQ ID NO: 1860 - protein, 450 aa, Artificial Sequence; identical to SEQ ID NO: 1856
  Synthetic Polypeptide

SEQ ID NO: 1861 - protein, 214 aa, Artificial Sequence; identical to SEQ ID NO: 200
  Synthetic Polypeptide

SEQ ID NO: 1862 - protein, 450 aa, Artificial Sequence; identical to SEQ ID NO: 1858
  Synthetic Polypeptide

SEQ ID NO: 1863 - protein, 219 aa, Artificial Sequence
  Synthetic Polypeptide
EIVLTQTPLSLSVTPGQPASISCKSSQSLLPSDAKTYLSWYLQKPGLPPQVLIYEVSNRFSGVPDRFSGSGSGTDFTLKISRVEAEDVGVYYCMQSIQLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1864 - protein, 457 aa, Artificial Sequence; identical to SEQ ID NO: 129
  Synthetic Polypeptide

SEQ ID NO: 1865 - protein, 219 aa, Artificial Sequence
  Synthetic Polypeptide
EIVLTQTPLSLSVTPGQPASISCKSSQSLLPSEGKTYLSWYLQKPGLPPQVLIYEVSNRFSGVPDRFSGSGSGTDFTLKISRVEAEDVGVYYCMQSIQLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1866 - protein, 457 aa, Artificial Sequence; identical to SEQ ID NO: 129
  Synthetic Polypeptide

SEQ ID NO: 1867 - protein, 219 aa, Artificial Sequence; identical to SEQ ID NO: 1863
  Synthetic Polypeptide

SEQ ID NO: 1868 - protein, 457 aa, Artificial Sequence
  Synthetic Polypeptide
QVQLQESGPGLVKPSETLSLTCIVSGGSIRSGDYYWSWIRQHPGKGLEWIGYIYYSGGTYYNPSLKSRVIISVDTTKNQFSLKLSSMTAADTAVYYCARGSIAARSGYFYFSGLDVWGQGPTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1869 - protein, 219 aa, Artificial Sequence; identical to SEQ ID NO: 1865
  Synthetic Polypeptide

SEQ ID NO: 1870 - protein, 457 aa, Artificial Sequence; identical to SEQ ID NO: 1868
  Synthetic Polypeptide

SEQ ID NO: 1871 - protein, 219 aa, Artificial Sequence; identical to SEQ ID NO: 1863
  Synthetic Polypeptide

SEQ ID NO: 1872 - protein, 457 aa, Artificial Sequence
  Synthetic Polypeptide
QVQLQESGPGLVNPSQTLSLTCIVSGGSIRSGDYYWSWIRQHPGKGLEWIGYIYYSGGTYYNPSLKSRVTISVDTTKNQFSLKLSSMTAADTAVYYCARGSIAARSGYFYFSGLDVWGQGPTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1873 - protein, 219 aa, Artificial Sequence; identical to SEQ ID NO: 1865
  Synthetic Polypeptide

SEQ ID NO: 1874 - protein, 457 aa, Artificial Sequence; identical to SEQ ID NO: 1872
  Synthetic Polypeptide

SEQ ID NO: 1875 - protein, 219 aa, Artificial Sequence; identical to SEQ ID NO: 1863
  Synthetic Polypeptide

SEQ ID NO: 1876 - protein, 457 aa, Artificial Sequence
  Synthetic Polypeptide
QVQLQESGPGLVKPSETLSLTCIVSGGSIRSGDYYWSWIRQHPGKGLEWIGYIYYSGGTYYNPSLKSRVTISVDTTKNQFSLKLSSMTAADTAVYYCARGSIAARSGYFYFSGLDVWGQGPTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1877 - protein, 219 aa, Artificial Sequence; identical to SEQ ID NO: 1865
  Synthetic Polypeptide

SEQ ID NO: 1878 - protein, 457 aa, Artificial Sequence; identical to SEQ ID NO: 1876
  Synthetic Polypeptide

SEQ ID NO: 1879 - protein, 219 aa, Artificial Sequence; identical to SEQ ID NO: 130
  Synthetic Polypeptide

SEQ ID NO: 1880 - protein, 457 aa, Artificial Sequence; identical to SEQ ID NO: 1868
  Synthetic Polypeptide

SEQ ID NO: 1881 - protein, 219 aa, Artificial Sequence; identical to SEQ ID NO: 130
  Synthetic Polypeptide

SEQ ID NO: 1882 - protein, 457 aa, Artificial Sequence; identical to SEQ ID NO: 1872
  Synthetic Polypeptide

SEQ ID NO: 1883 - protein, 219 aa, Artificial Sequence; identical to SEQ ID NO: 130
  Synthetic Polypeptide

SEQ ID NO: 1884 - protein, 457 aa, Artificial Sequence; identical to SEQ ID NO: 1876
  Synthetic Polypeptide

SEQ ID NO: 1885 - protein, 219 aa, Artificial Sequence; identical to SEQ ID NO: 1863
  Synthetic Polypeptide

SEQ ID NO: 1886 - protein, 457 aa, Artificial Sequence
  Synthetic Polypeptide
QVQLQESGPGLVKPSETLSLTCIVSGGSIRSGDYYWSWIRQPPGKGLEWIGYIYYSGGTYYNPSLKSRVIISVDTTKNQFSLKLSSMTAADTAVYYCARGSIAARSGYFYFSGLDVWGQGPTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1887 - protein, 219 aa, Artificial Sequence; identical to SEQ ID NO: 1865
  Synthetic Polypeptide

SEQ ID NO: 1888 - protein, 457 aa, Artificial Sequence
  Synthetic Polypeptide
QVQLQESGPGLVNPSQTLSLTCIVSGGSIRSGDYYWSWIRQPPGKGLEWIGYIYYSGGTYYNPSLKSRVIISVDTTKNQFSLKLSSMTAADTAVYYCARGSIAARSGYFYFSGLDVWGQGPTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1889 - protein, 219 aa, Artificial Sequence; identical to SEQ ID NO: 1863
  Synthetic Polypeptide

SEQ ID NO: 1890 - protein, 457 aa, Artificial Sequence
  Synthetic Polypeptide
QVQLQESGPGLVKPSETLSLTCIVSGGSISSGDYYWSWIRQPPGKGLEWIGYIYYSGGTYYNPSLKSRVTISVDTTKNQFSLKLSSMTAADTAVYYCARGSIAARSGYFYFSGLDVWGQGPTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1891 - protein, 219 aa, Artificial Sequence; identical to SEQ ID NO: 130
  Synthetic Polypeptide

SEQ ID NO: 1892 - protein, 457 aa, Artificial Sequence; identical to SEQ ID NO: 1890
  Synthetic Polypeptide

SEQ ID NO: 1893 - protein, 219 aa, Artificial Sequence
  Synthetic Polypeptide
EIVLTQTPLSLSVTPGQPASISCKSSQSLLPSDAKTYLSWYLQKPGLPPQVLIYEVSNRFSGVPDRFSGSGSGTDFTLKISRVEAEDVGVYYCMQSIQLPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1894 - protein, 457 aa, Artificial Sequence; identical to SEQ ID NO: 1868
  Synthetic Polypeptide

SEQ ID NO: 1895 - protein, 219 aa, Artificial Sequence; identical to SEQ ID NO: 1893
  Synthetic Polypeptide

SEQ ID NO: 1896 - protein, 457 aa, Artificial Sequence; identical to SEQ ID NO: 129
  Synthetic Polypeptide

SEQ ID NO: 1897 - protein, 219 aa, Artificial Sequence
  Synthetic Polypeptide
EIVLTQTPLSLSVTPGQPASISCKSSQSLLPSEGKTYLSWYLQKPGLPPQVLIYEVSNRFSGVPDRFSGSGSGTDFTLKISRVEAEDVGVYYCMQSIQLPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1898 - protein, 457 aa, Artificial Sequence; identical to SEQ ID NO: 1876
  Synthetic Polypeptide

SEQ ID NO: 1899 - protein, 219 aa, Artificial Sequence; identical to SEQ ID NO: 1893
  Synthetic Polypeptide

SEQ ID NO: 1900 - protein, 457 aa, Artificial Sequence; identical to SEQ ID NO: 1890
  Synthetic Polypeptide

SEQ ID NO: 1901 - protein, 219 aa, Artificial Sequence
  Synthetic Polypeptide
EIVLTQTPLSLSVTPGQPASISCKSSQSLLPSEGKTYLSWYLQKPGQSPQVLIYEVSNRFSGVPDRFSGSGSGTDFTLKISRVEAEDVGVYYCMQSIQLPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1902 - protein, 457 aa, Artificial Sequence
  Synthetic Polypeptide
QVQLQESGPGLVKPSETLSLTCIVSGGSISSGDYYWSWIRQPPGKGLEWIGYIYYSGGTYYNPSLKSRVTISVDTTKNQFSLKLSSMTAADTAVYYCARGSIAARSGYFYFSGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1903 - protein, 219 aa, Artificial Sequence
  Synthetic Polypeptide
EIVLTQTPLSLSVTPGQPASISCKSSQSLLPSDAKTYLSWYLQKPGQSPQVLIYEVSNRFSGVPDRFSGSGSGTDFTLKISRVEAEDVGVYYCMQSIQLPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1904 - protein, 457 aa, Artificial Sequence; identical to SEQ ID NO: 1902
  Synthetic Polypeptide

SEQ ID NO: 1905 - protein, 219 aa, Artificial Sequence; identical to SEQ ID NO: 1863
  Synthetic Polypeptide

SEQ ID NO: 1906 - protein, 457 aa, Artificial Sequence
  Synthetic Polypeptide
QVQLQESGPGLVNPSQTLSLTCIVSGGSIRSGDYYWSWIRQHPGKGLEWIGYIYYSGGTYYNPSLKSRVIISVDTTKNQFSLKLSSMTAADTAVYYCARGSIAARSGYFYFSGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1907 - protein, 219 aa, Artificial Sequence; identical to SEQ ID NO: 1863
  Synthetic Polypeptide

SEQ ID NO: 1908 - protein, 457 aa, Artificial Sequence
  Synthetic Polypeptide
QVQLQESGPGLVKPSETLSLTCIVSGGSIRSGDYYWSWIRQHPGKGLEWIGYIYYSGGTYYNPSLKSRVIISVDTTKNQFSLKLSSMTAADTAVYYCARGSIAARSGYFYFSGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1909 - protein, 219 aa, Artificial Sequence
  Synthetic Polypeptide
EIVLTQTPLSLSVTPGQPASISCKSSQSLLPSDGKTYLSWYLQKPGQSPQVLIYEVSNRFSGVPDRFSGSGSGTDFTLKISRVEAEDVGVYYCMQSIQLPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1910 - protein, 457 aa, Artificial Sequence; identical to SEQ ID NO: 1902
  Synthetic Polypeptide

SEQ ID NO: 1911 - protein, 219 aa, Artificial Sequence
  Synthetic Polypeptide
EIVLTQTPLSLSVTPGQPASISCKSSQSLLPSDGKTYLSWYLQKPGLPPQVLIYEVSNRFSGVPDRFSGSGSGTDFTLKISRVEAEDVGVYYCMQSIQLPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1912 - protein, 457 aa, Artificial Sequence; identical to SEQ ID NO: 1902
  Synthetic Polypeptide

SEQ ID NO: 1913 - protein, 216 aa, Artificial Sequence
  Synthetic Polypeptide
QAGLTQPPSVSKGLRQTATLTCTGNSNNVGNRGAAWLQQHQGHPPKLLSYRNNNRPSGISERLSASRSGNTASLTITGLQPEDEADYYCSAWDSSLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1914 - protein, 452 aa, Artificial Sequence; identical to SEQ ID NO: 179
  Synthetic Polypeptide

SEQ ID NO: 1915 - protein, 216 aa, Artificial Sequence; identical to SEQ ID NO: 645
  Synthetic Polypeptide

SEQ ID NO: 1916 - protein, 452 aa, Artificial Sequence; identical to SEQ ID NO: 179
  Synthetic Polypeptide

SEQ ID NO: 1917 - protein, 216 aa, Artificial Sequence
  Synthetic Polypeptide
QAGLTQPPSVSKGLRQTATLTCTGQTNNVGNRGAAWLQQHQGHPPKLLSYRNNNRPSGISERLSASRSGNTASLTITGLQPEDEADYYCSAWDSSLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1918 - protein, 452 aa, Artificial Sequence; identical to SEQ ID NO: 179
  Synthetic Polypeptide

SEQ ID NO: 1919 - protein, 216 aa, Artificial Sequence
  Synthetic Polypeptide
QAGLTQPPSVSKGLRQTATLTCTGNSNNVGNRGAAWLQQHQGHPPKLLSYRNNNRPSGISERLSASRSGNTASLTITGLQPEDEADYYCSAYDSSLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1920 - protein, 452 aa, Artificial Sequence
  Synthetic Polypeptide
QVQLVESGGGVVQPGRSLRLSCAASGFTFSSYGMHWVRQAPGKGLEWVALIWFDESNIYYADAVKGRFTISRDNSKNTLYLQMNSLRAEDTAVYFCARGYDLLTGYYNFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1921 - protein, 216 aa, Artificial Sequence
  Synthetic Polypeptide
QAGLTQPPSVSKGLRQTATLTCTGNANNVGNRGAAWLQQHQGHPPKLLSYRNNNRPSGISERLSASRSGNTASLTITGLQPEDEADYYCSAWDASLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1922 - protein, 452 aa, Artificial Sequence
  Synthetic Polypeptide
EVQLVESGGGVVQPGGSLRLSCAASGFTFSSYGMHWVRQAPGKGLEWVALIWFDESNIYYADAVKGRFTISRDNAKNTLYLQMNSLRAEDTAVYFCARGYDLLTGYYNFDFWGLGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1923 - protein, 216 aa, Artificial Sequence; identical to SEQ ID NO: 645
  Synthetic Polypeptide

SEQ ID NO: 1924 - protein, 452 aa, Artificial Sequence
  Synthetic Polypeptide
EVQLVESGGGVVQPGGSLRLSCAASGFTFSSYGMHWVRQAPGKGLEWVALIWFDESNIYYADAVKGRFTISRDNAKNTLYLQMNSLRAEDTAVYFCARGYDLLTGYYNFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1925 - protein, 216 aa, Artificial Sequence; identical to SEQ ID NO: 1917
  Synthetic Polypeptide

SEQ ID NO: 1926 - protein, 452 aa, Artificial Sequence
  Synthetic Polypeptide
QVQLVESGGGVVQPGRSLRLSCAASGFTFSSYGMHWVRQAPGKGLEWVALIWFDESNIYYADSVKGRFTISRDNSKNTLYLQMNSLRAEDTAVYFCARGYDLLTGYYNFDFWGLGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1927 - protein, 216 aa, Artificial Sequence
  Synthetic Polypeptide
QAGLTQPPSVSKGLRQTATLTCTGQTNNVGNRGAAWLQQHQGHPPKLLSYRNNNRPSGISERLSASRSGNTASLTITGLQPEDEADYYCSAYDASLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1928 - protein, 452 aa, Artificial Sequence; identical to SEQ ID NO: 1920
  Synthetic Polypeptide

SEQ ID NO: 1929 - protein, 215 aa, Artificial Sequence; identical to SEQ ID NO: 1737
  Synthetic Polypeptide

SEQ ID NO: 1930 - protein, 453 aa, Artificial Sequence
  Synthetic Polypeptide
QVQLQESGPGLVKPSQTLSLTCTVSGGSISSGGYYWNWIRQHPGKGLEWIGYIYYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1931 - protein, 215 aa, Artificial Sequence; identical to SEQ ID NO: 1737
  Synthetic Polypeptide

SEQ ID NO: 1932 - protein, 453 aa, Artificial Sequence
  Synthetic Polypeptide
QVQLQESGPGLVKPSETLSLTCTVSGGSISSGGYYWNWIRQHPGKGLEWIGYIYYSGSTFYNPSLKSRVIISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1933 - protein, 215 aa, Artificial Sequence; identical to SEQ ID NO: 1737
  Synthetic Polypeptide

SEQ ID NO: 1934 - protein, 453 aa, Artificial Sequence; identical to SEQ ID NO: 209
  Synthetic Polypeptide

SEQ ID NO: 1935 - protein, 215 aa, Artificial Sequence; identical to SEQ ID NO: 1737
  Synthetic Polypeptide

SEQ ID NO: 1936 - protein, 453 aa, Artificial Sequence
  Synthetic Polypeptide
QVQLQESGPGLVKPSETLSLTCTVSGGSISSGGYYWNWIRQHPGKGLEWIGYIYYSGSTFYNPSLKSRVTISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1937 - protein, 215 aa, Artificial Sequence; identical to SEQ ID NO: 210
  Synthetic Polypeptide

SEQ ID NO: 1938 - protein, 453 aa, Artificial Sequence
  Synthetic Polypeptide
QVQLQESGPGLVKPSQTLSLTCTVSGGSISSGGYYWNWIRQHPGKGLEWIGYIYYSGSTFYNPSLKSRVIISVDTSKNQFSLKLSSVTAADTAVYYCARAPRYNYNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1939 - protein, 215 aa, Artificial Sequence; identical to SEQ ID NO: 210
  Synthetic Polypeptide

SEQ ID NO: 1940 - protein, 453 aa, Artificial Sequence
  Synthetic Polypeptide
QVQLQESGPGLVKPSQTLSLTCTVSGGSISSGGYYWNWIRQHPGKGLEWIGYIYYSGSTFYNPSLKSRVIISVDTSKNQFSLKLSSVTAADTAVYYCARAPRYNFNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1941 - protein, 215 aa, Artificial Sequence; identical to SEQ ID NO: 210
  Synthetic Polypeptide

SEQ ID NO: 1942 - protein, 453 aa, Artificial Sequence; identical to SEQ ID NO: 1930
  Synthetic Polypeptide

SEQ ID NO: 1943 - protein, 215 aa, Artificial Sequence; identical to SEQ ID NO: 210
  Synthetic Polypeptide

SEQ ID NO: 1944 - protein, 453 aa, Artificial Sequence
  Synthetic Polypeptide
QVQLQESGPGLVKPSQTLSLTCTVSGGSISSGGYYWNWIRQPPGKGLEWIGYIYYSGSTFYNPSLKSRVIISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1945 - protein, 215 aa, Artificial Sequence; identical to SEQ ID NO: 210
  Synthetic Polypeptide

SEQ ID NO: 1946 - protein, 453 aa, Artificial Sequence; identical to SEQ ID NO: 1932
  Synthetic Polypeptide

SEQ ID NO: 1947 - protein, 215 aa, Artificial Sequence; identical to SEQ ID NO: 210
  Synthetic Polypeptide

SEQ ID NO: 1948 - protein, 453 aa, Artificial Sequence; identical to SEQ ID NO: 1936
  Synthetic Polypeptide

SEQ ID NO: 1949 - protein, 215 aa, Artificial Sequence; identical to SEQ ID NO: 210
  Synthetic Polypeptide

SEQ ID NO: 1950 - protein, 453 aa, Artificial Sequence
  Synthetic Polypeptide
QVQLQESGPGLVKPSETLSLTCTVSGGSISSGGYYWNWIRQPPGKGLEWIGYIYYSGSTFYNPSLKSRVTISVDTSKNQFSLKLSSVTAADTAVYYCARAPRYNFNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1951 - protein, 215 aa, Artificial Sequence; identical to SEQ ID NO: 210
  Synthetic Polypeptide

SEQ ID NO: 1952 - protein, 453 aa, Artificial Sequence
  Synthetic Polypeptide
QVQLQESGPGLVKPSQTLSLTCTVSGGSISSGGYYWNWIRQHPGKGLEWIGYIYYSGSTFYNPSLKSRVTISVDTSKNQFSLKLSSVTAADTAVYYCARAPRYNFNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1953 - protein, 214 aa, Artificial Sequence
  Synthetic Polypeptide
EIVLTQSPDFQSVTPKEKVTITCRASQSIGSSLHWYQQKPDQSPKPLIKYVSQSFSGVPSRFSGSGSGTDFTLTINSLEAEDAATYYCHQSSSLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1954 - protein, 457 aa, Artificial Sequence; identical to SEQ ID NO: 189
  Synthetic Polypeptide

SEQ ID NO: 1955 - protein, 214 aa, Artificial Sequence; identical to SEQ ID NO: 190
  Synthetic Polypeptide

SEQ ID NO: 1956 - protein, 457 aa, Artificial Sequence
  Synthetic Polypeptide
QVQLQESGPGLVKPSETLSLTCTVSGGSISSVYFYWNWIRQHPGKGLEWIGYIYYSGGTYYNPSLRSRVTISVDTSKNQFSLKLNSVTAADTAVYYCARGSIAAGGGYFYYNDMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1957 - protein, 214 aa, Artificial Sequence; identical to SEQ ID NO: 190
  Synthetic Polypeptide

SEQ ID NO: 1958 - protein, 457 aa, Artificial Sequence
  Synthetic Polypeptide
QVQLQESGPGLVKPSQTLSLTCTVSGGSISSVYFYWNWIRQPPGKGLEWIGYIYYSGGTYYNPSLRSRVTISVDTSKNQFSLKLNSVTAADTAVYYCARGSIAAGGGYFYYNDMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1959 - protein, 214 aa, Artificial Sequence; identical to SEQ ID NO: 1953
  Synthetic Polypeptide

SEQ ID NO: 1960 - protein, 457 aa, Artificial Sequence; identical to SEQ ID NO: 1956
  Synthetic Polypeptide

SEQ ID NO: 1961 - protein, 214 aa, Artificial Sequence; identical to SEQ ID NO: 1953
  Synthetic Polypeptide

SEQ ID NO: 1962 - protein, 457 aa, Artificial Sequence; identical to SEQ ID NO: 1958
  Synthetic Polypeptide

SEQ ID NO: 1963 - protein, 214 aa, Artificial Sequence; identical to SEQ ID NO: 1953
  Synthetic Polypeptide

SEQ ID NO: 1964 - protein, 457 aa, Artificial Sequence; identical to SEQ ID NO: 219
  Synthetic Polypeptide

SEQ ID NO: 1965 - protein, 214 aa, Artificial Sequence; identical to SEQ ID NO: 1799
  Synthetic Polypeptide

SEQ ID NO: 1966 - protein, 452 aa, Artificial Sequence; identical to SEQ ID NO: 159
  Synthetic Polypeptide

SEQ ID NO: 1967 - protein, 215 aa, Artificial Sequence; identical to SEQ ID NO: 1737
  Synthetic Polypeptide

SEQ ID NO: 1968 - protein, 453 aa, Artificial Sequence; identical to SEQ ID NO: 1944
  Synthetic Polypeptide

SEQ ID NO: 1969 - protein, 444 aa, Artificial Sequence
  Synthetic Polypeptide
QVQLVQSGGEVKKPGASVKVSCKASGFTFTSYDINWVRQATGQGLEWMGWMNHYSGDSDYAQKLQGRVIITRNTSITTAYMELSSLRSEDTAVYYCGRERFPFGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1970 - protein, 214 aa, Artificial Sequence
  Synthetic Polypeptide
DIQMTHSPSSLSASIGDRVTITCRASQGIRNELGWYQKKPGKAPKRLIYSASSLQSGVPSRFSGSGSGTEFTLTISSLQPEDFATYYCLQHNTYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1971 - protein, 118 aa, Artificial Sequence
  Synthetic Polypeptide
QVQLVQSGGEVKKPGASVKVSCKASGFTFTSYDINWVRQATGQGLEWMGWMNHYSGDSDYAQKLQGRVIITRNTSITTAYMELSSLRSEDTAVYYCGRERFPFGMDVWGQGTTVTVSS

SEQ ID NO: 1972 - protein, 107 aa, Artificial Sequence
  Synthetic Polypeptide
DIQMTHSPSSLSASIGDRVTITCRASQGIRNELGWYQKKPGKAPKRLIYSASSLQSGVPSRFSGSGSGTEFTLTISSLQPEDFATYYCLQHNTYPLTFGGGTKVEIK

SEQ ID NO: 1973 - protein, 5 aa, Artificial Sequence
  Synthetic Polypeptide
SYDIN

SEQ ID NO: 1974 - protein, 17 aa, Artificial Sequence
  Synthetic Polypeptide
WMNHYSGDSDYAQKLQG

SEQ ID NO: 1975 - protein, 9 aa, Artificial Sequence
  Synthetic Polypeptide
ERFPFGMDV

SEQ ID NO: 1976 - protein, 11 aa, Artificial Sequence
  Synthetic Polypeptide
RASQGIRNELG

SEQ ID NO: 1977 - protein, 7 aa, Artificial Sequence
  Synthetic Polypeptide
SASSLQS

SEQ ID NO: 1978 - protein, 9 aa, Artificial Sequence
  Synthetic Polypeptide
LQHNTYPLT

SEQ ID NO: 1979 - protein, 443 aa, Artificial Sequence
  Synthetic Polypeptide
EVQLVESGGGLVQPGGSLRLSCAASGFTFRNYDMHWVRQVPGKGLEWVSDIGNSGETYYLGSVKGRFTISRENAKNSLYLQMNSLRAGDTAVYYCVREEFGNGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1980 - protein, 214 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNNYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1981 - protein, 117 aa, Artificial Sequence
  Synthetic Polypeptide
EVQLVESGGGLVQPGGSLRLSCAASGFTFRNYDMHWVRQVPGKGLEWVSDIGNSGETYYLGSVKGRFTISRENAKNSLYLQMNSLRAGDTAVYYCVREEFGNGMDVWGQGTTVTVSS

SEQ ID NO: 1982 - protein, 107 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNNYPLTFGGGTKVEIK

SEQ ID NO: 1983 - protein, 5 aa, Artificial Sequence
  Synthetic Polypeptide
NYDMH

SEQ ID NO: 1984 - protein, 16 aa, Artificial Sequence
  Synthetic Polypeptide
DIGNSGETYYLGSVKG

SEQ ID NO: 1985 - protein, 9 aa, Artificial Sequence
  Synthetic Polypeptide
EEFGNGMDV

SEQ ID NO: 1986 - protein, 11 aa, Artificial Sequence
  Synthetic Polypeptide
RASQGIRNDLG

SEQ ID NO: 1987 - protein, 7 aa, Artificial Sequence
  Synthetic Polypeptide
AASSLQS

SEQ ID NO: 1988 - protein, 9 aa, Artificial Sequence
  Synthetic Polypeptide
LQHNNYPLT

SEQ ID NO: 1989 - protein, 443 aa, Artificial Sequence
  Synthetic Polypeptide
EVQLVESGGGLVQPGGSLRLSCAASGFTFSNYDMHWVRQATGKGLEWVSDIGNAGETYYLDSVKGRFTISRENAKNSLYLQMNSLRAGDTAVYYCVREEFGHGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1990 - protein, 214 aa, Artificial Sequence
  Synthetic Polypeptide
DIQMTQSPSSLSASVGDRVTITCRASQGIRSDLGWYQQKPGKAPKRLIYAASSLQSGVPSRFSGSGSGTEFTLTISSLQPEDFATYYCLQHNSYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1991 - protein, 117 aa, Artificial Sequence
  Synthetic Polypeptide
EVQLVESGGGLVQPGGSLRLSCAASGFTFSNYDMHWVRQATGKGLEWVSDIGNAGETYYLDSVKGRFTISRENAKNSLYLQMNSLRAGDTAVYYCVREEFGHGMDVWGQGTTVTVSS

SEQ ID NO: 1992 - protein, 107 aa, Artificial Sequence
  Synthetic Polypeptide
DIQMTQSPSSLSASVGDRVTITCRASQGIRSDLGWYQQKPGKAPKRLIYAASSLQSGVPSRFSGSGSGTEFTLTISSLQPEDFATYYCLQHNSYPFTFGGGTKVEIK

SEQ ID NO: 1993 - protein, 5 aa, Artificial Sequence
  Synthetic Polypeptide
NYDMH

SEQ ID NO: 1994 - protein, 16 aa, Artificial Sequence
  Synthetic Polypeptide
DIGNAGETYYLDSVKG

SEQ ID NO: 1995 - protein, 9 aa, Artificial Sequence
  Synthetic Polypeptide
EEFGHGMDV

SEQ ID NO: 1996 - protein, 11 aa, Artificial Sequence
  Synthetic Polypeptide
RASQGIRSDLG

SEQ ID NO: 1997 - protein, 7 aa, Artificial Sequence
  Synthetic Polypeptide
AASSLQS

SEQ ID NO: 1998 - protein, 9 aa, Artificial Sequence
  Synthetic Polypeptide
LQHNSYPFT

SEQ ID NO: 1999 - protein, 444 aa, Artificial Sequence
  Synthetic Polypeptide
EVQLVESGGGLVQPGGSLRLSCAASGFTFSRDDMHWVRQATGKGLEWVAAIDNAGDTYYPGSVKGRFTISRENAKNSLYLQMNSLRAGDTAVYYCAREGQWPYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2000 - protein, 214 aa, Artificial Sequence
  Synthetic Polypeptide
DIQMTQSPSSLSASVGDRVTITCRASQGIRNDLGWYQQKPGKAPKRLIYAASTLQSGVSSRFSGSGSGTEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2001 - protein, 118 aa, Artificial Sequence
  Synthetic Polypeptide
EVQLVESGGGLVQPGGSLRLSCAASGFTFSRDDMHWVRQATGKGLEWVAAIDNAGDTYYPGSVKGRFTISRENAKNSLYLQMNSLRAGDTAVYYCAREGQWPYGMDVWGQGTTVTVSS

SEQ ID NO: 2002 - protein, 107 aa, Artificial Sequence
  Synthetic Polypeptide
DIQMTQSPSSLSASVGDRVTITCRASQGIRNDLGWYQQKPGKAPKRLIYAASTLQSGVSSRFSGSGSGTEFTLTISSLQPEDFATYYCLQHNSYPLTFGGGTKVEIK

SEQ ID NO: 2003 - protein, 5 aa, Artificial Sequence
  Synthetic Polypeptide
RDDMH

SEQ ID NO: 2004 - protein, 16 aa, Artificial Sequence
  Synthetic Polypeptide
AIDNAGDTYYPGSVKG

SEQ ID NO: 2005 - protein, 10 aa, Artificial Sequence
  Synthetic Polypeptide
EGQWPYGMDV

SEQ ID NO: 2006 - protein, 11 aa, Artificial Sequence
  Synthetic Polypeptide
RASQGIRNDLG

SEQ ID NO: 2007 - protein, 7 aa, Artificial Sequence
  Synthetic Polypeptide
AASTLQS

SEQ ID NO: 2008 - protein, 9 aa, Artificial Sequence
  Synthetic Polypeptide
LQHNSYPLT

SEQ ID NO: 2009 - protein, 418 aa, Artificial Sequence
  Synthetic Polypeptide
QVQLQESGPGLVKPSQTLSLTCTVSGGSISSGGYYWNWIRQHPGKGLEWIGYIYYSGSTFYNPSLKSRVIISVDTSKNQFSLKLSSVTAADTAVYYCARAPRYNWNYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTV

SEQ ID NO: 2010 - protein, 215 aa, Artificial Sequence; identical to SEQ ID NO: 1583
  Synthetic Polypeptide

SEQ ID NO: 2011 - protein, 123 aa, Artificial Sequence
  Synthetic Polypeptide
QVQLQESGPGLVKPSQTLSLTCTVSGGSISSGGYYWNWIRQHPGKGLEWIGYIYYSGSTFYNPSLKSRVIISVDTSKNQFSLKLSSVTAADTAVYYCARAPRYNWNYGWFDPWGQGTLVTVSS

SEQ ID NO: 2012 - protein, 108 aa, Artificial Sequence
  Synthetic Polypeptide
EIVLTQSPGTLSLSPGERATLSCRASQNVSSTYLAWYQQKPGQAPRLLFYGASSRATGIPDRFSRSGSGTDFTLTISRLEPEDFAVYYCQQYDVSPWTFGQGTKVEIK

SEQ ID NO: 2013 - protein, 7 aa, Artificial Sequence
  Synthetic Polypeptide
SGGYYWN

SEQ ID NO: 2014 - protein, 16 aa, Artificial Sequence
  Synthetic Polypeptide
YIYYSGSTFYNPSLKS

SEQ ID NO: 2015 - protein, 13 aa, Artificial Sequence
  Synthetic Polypeptide
APRYNWNYGWFDP

SEQ ID NO: 2016 - protein, 12 aa, Artificial Sequence
  Synthetic Polypeptide
RASQNVSSTYLA

SEQ ID NO: 2017 - protein, 7 aa, Artificial Sequence
  Synthetic Polypeptide
GASSRAT

SEQ ID NO: 2018 - protein, 9 aa, Artificial Sequence
  Synthetic Polypeptide
QQYDVSPWT

SEQ ID NO: 2019 - protein, 19 aa, Artificial Sequence
  Synthetic Polypeptide
PREEQYNSTYRVVSVLTVL

SEQ ID NO: 2020 - protein, 399 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTLDSDGSFFLYSKLTVDKSRWQQGNVFSCSVMHEALHNHYTQKSLSLSPGKLPAPIEKTISKAKGQPREPQVYTLPPSREEMTKNQVSLTCLVKGFYPSDIAVEWESNGQPENNYKTTPPLPAPIEKTISKAKGQPREPQVYTLPPSREEMTKNQVSLTCLVKGFYPSDIAVEWESNGQPENNYKTTPPVVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKA

SEQ ID NO: 2021 - protein, 5 aa, Artificial Sequence
  Synthetic Polypeptide
GGGGS

SEQ ID NO: 2022 - protein, 322 aa, Artificial Sequence
  Macaca fascicularis
MRTEAQVLALQSPEPGLEGAMGRRTLALPWVLLTLCVTAGTPEVWVQVQMEATELSSFTVHCGFLGPGSISLVTVSWGGPDGAGGTKLAVLHPELGTRQWAPARQARWETQSSISLALEDSGASSPFANTTFCCKFASFPEGSWESCGSLPPSSDPGLSAPPTPVPILRADLAGILGLSGVLLFGCGYLLHLLRRQKHRPTPRLQPSHTNSQALTAQAWAPSQASQAALHDPYATINTSFCPATLDTAHPNGWASLPTHAAHQPQGPAASASTPILARGSFVSVENGLYTQAGERPPHTGPGLTLFPDCRGPRALEGRFGVR

SEQ ID NO: 2023 - DNA, 2607 bp, Artificial Sequence
  Macaca fascicularis
gctagcaaaggtcttgttctgcaggtgacacctcacagctggtgctctgcggagcctgtggtaagcaagtccttcagacccttaaaggggtcccgcctctcagtttgtctttcctagatccagacatggagactgcagagaaaggctgtgtgcatctgctgtctattccaccatctcctctgcagaggcggatttccctgactgaagaccacgttgcaggcccacagctgcctacaagccctctgggcaaccatcccaaaatatggctaagaagcctattctgagagataaagtctcaccatgttgcccaggctggtcttgaactcctggactcatcctaaagtgctggcctctcattccctgtctgtgcacacctcacggcaagggccagcccgtttcctcctggtcacctccaaatcttgctgcttttaattcaactcagaggtatgcacgtgaggtaggagggcaggggaggtggggatggcaggacatggatggtccttgaggcgtcgactctgggtgtcatggactgtgagagtcaagaagggcagtggcctgcctaacttgggttcaaaagtgtcactctggccactgcggtgagaactgaaaccagccaggccaattctccattgtttctgctcttccaggcaggagaatattaggcctggagtcagaaggtagcagtggctggggattgtcggggggtgttgggaagaagtggtcctttggtcagggtgggaagccaacaggatttcctggtgcattggaggtgaaagcgaagaggcactggtggctgtgctttggtcctgagcagccagaagccagttgccatcacctatgacaagggagacggcacctggagcagagcccagtatggggtgcgttcagggtagatcaggaggtatgagtgggcagtgggcaagtgaggctgggggttgtcggggaggcctgggttgcaggtgtaagcgtgggacccacgtcagattggtggcgggtcacgcacactgggctggctttcaggtcctccttgctggcttcccgctcccagggactttctcctcccagattccttagctgggtaaggggtaggacagagccctttcctagggaagcccggcatcccttgctgtccagggaagggggagtccttccagaccctggcagctactccgcccctcccctggcctccccaggcctagccagggctgggttctcacccacctgtgccaccctgccttgttacccggaagcacagccttggggactgagcgggccctcactgtcactttaagaagggaatcagccaccttgtgttcaccacctctggggaaggtgtgagaggggagaaggaagtggctgtttggctgctgacaacatgaagacttcctgcgatgagaacagaggcacaggtgctggccctgcagtccccagaacccggactggagggggccatggggcgccggaccctggccctgccctgggtgctgctgaccctgtgtgtcactgcggggaccccggaggtgtgggtgcaagttcagatggaggccactgagctctcgtccttcactgtccattgtgggttcctggggcctggctccatctccctggtgactgtgagctggggaggccccgatggtgctggggggaccaagctggctgtgttgcacccagaacttggcacccggcaatgggcccctgctcgccaggcccgctgggaaacccagagcagcatctctctcgccctggaagactctggggccagcagccccttcgccaacaccaccttctgctgcaagtttgcatccttccctgaaggctcctgggagtcctgtgggagcctcccgcccagctcagacccagggctctctgccccgccaactcctgtccccattctgcgggcagatctggccgggatcttggggctctcaggagtcctcctctttggctgtggatacctccttcacctgctgcgccgacagaagcaccgccctacccctaggctacagccatcccacaccaactcccaggcactgacagcacaagcatgggcgcccagccaggcctcccaggctgctctccacgacccttatgccactatcaacaccagcttctgcccagctactttggacacggctcaccccaacgggtgggcatcgctccccacccacgccgcacaccagccccagggccctgccgcctcggcctccacacccatccttgcacgtggcagctttgtctctgttgagaacggactctacactcaggcaggggagaggcctccccacaccggtcccggcctcactcttttccctgactgtcggggtcccagggccttggaaggacgcttcggagttcgatgagagagaccatgaggccactggactttccccttccctggcctcctgggcgccacccccttactttattcttgggcctccaataagtgtaccacgggtacttggccaggcccacctgctgcggatgtggtctgtgtgtgtgcatgcgtgggggtgtgtgggcacaggtgtgagtgtgtgcgtgacagaaccccattccagtcgtttcctgccgtgacgaagtcagcaacacagtttctctgacttgggc

SEQ ID NO: 2024 - protein, 245 aa, Artificial Sequence
  Macaca fascicularis
MRWCLFLIWAQGLRQAPLASGMMTGTIETTGNISAKKGGSVILQCHLSSTMAQVTQVNWEQHDHSLLAIRNAELGWHIYPAFKDRVAPGPGLGLTLQSLTMNDTGEYFCTYHTYPDGTYRGRIFLEVLESSVAEHSARFQIPLLGAMAMMLVVICIAVIVVVVLARKKKSLRIHSVESGLQRKSTGQEEQIPSAPSPPGSCVQAEAAPAGLCGEQQGDDCAELHDYFNVLSYRSLGSCSFFTETG

SEQ ID NO: 2025 - DNA, 1304 bp, Artificial Sequence
  Macaca fascicularis
gaccccctcctgctgcaggatgttgcccttgttcgaggcagagacaggaggcctcagacagctgtgacagccctggagctctcctaccacatctgagccagagggaagactttggagaagcagaagcccaaagacactgctgggagattggtctgtgctctgggagaaccctaggttgtgtttcccgtgtacaagtcacggatcttctggaaggctcagttttaccgtcctatctgcagtcggctactttcggtggcagaagaggccacatctgcttcctgtaagccctctgggcagaagcatgcggtggtgtctcttcctgatctgggcccaggggctgaggcaggctcccctcgcctcaggaatgatgacaggcacaatagaaacaacggggaacatttctgcaaagaaaggtggctctgttatcttacaatgtcacctctcctccaccatggcacaagtgacccaggtcaactgggagcagcatgaccattcgcttctggccattcgtaatgctgagttggggtggcacatctacccagccttcaaggatcgagtggccccgggtcctggcctgggcctcaccctccagtcgctgaccatgaatgatacaggggagtacttctgcacctatcacacctaccctgatgggacttacagagggagaatcttcctggaggtcctagaaagctcagtggctgagcacagtgccaggttccagattccattgcttggagccatggccatgatgctggtggtcatctgcatagcagtcatcgtggtggtcgtgttggctagaaagaagaaatccctcagaatccattctgtggaaagtggcctccagagaaaatcaactggacaggaagaacagattcccagtgctccctcacccccaggaagctgtgtccaggcagaagctgcacctgctgggctctgtggagagcagcagggagatgactgtgccgagctgcatgactacttcaatgtcctgagttacagaagcctggggagctgcagcttcttcacagagactgggtagcaaacagaggcatgttctggaagatacacttttgtcttgactattatagatgtcttgactaatatataaacagctgtattcgccatcagtgtgcgcgcgcgtgtgtgttcagttgagtgaataaatgtcatcctcttctctatcttcattttcttggccttttcgttctattccattatgcattatggcaggcctagggtgagtaacatggatcttgatcataaatgcaaaattgaaaaaatatcttgacctgattttaaatctg

SEQ ID NO: 2026 - protein, 325 aa, Artificial Sequence
  Synthetic Polypeptide
MRTEAQVPALQPPEPGLEGAMGHRTLVLPWVLLTLCVTAGTPEVWVQVRMEATELSSFTIRCGFLGSGSISLVTVSWGGPDGAGGTTLAVLHPERGIRQWAPARQARWETQSSISLILEGSGASSPCANTTFCCKFASFPEGSWEACGSLPPSSDPGLSAPPTPAPILRADLGILGVSGVLLFGCVYLLHLLRRHKHRPAPRLQPSRTSPQAPRARAWAPSQASQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

SEQ ID NO: 2027 - protein, 5 aa, Artificial Sequence
  Synthetic Polypeptide
SYDMS

SEQ ID NO: 2028 - protein, 16 aa, Artificial Sequence
  Synthetic Polypeptide
LISGGGSQTYYAESVK

SEQ ID NO: 2029 - protein, 11 aa, Artificial Sequence
  Synthetic Polypeptide
PSGHYFYAMDV

SEQ ID NO: 2030 - protein, 11 aa, Artificial Sequence
  Synthetic Polypeptide
RASQGISNWLA

SEQ ID NO: 2031 - protein, 7 aa, Artificial Sequence
  Synthetic Polypeptide
AASSLQS

SEQ ID NO: 2032 - protein, 9 aa, Artificial Sequence
  Synthetic Polypeptide
QQAESFPHT

SEQ ID NO: 2033 - protein, 120 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSS

SEQ ID NO: 2034 - protein, 107 aa, Artificial Sequence
  Synthetic Polypeptide
DIQMTQSPSSVSASVGDRVTITCRASQGISNWLAWYQQKPGKAPKLLIFAASSLQSGVPSRFSGSGSGTDFTLTISSLQPEDFATYYCQQAESFPHTFGGGTKVEIK

SEQ ID NO: 2035 - protein, 472 aa, Artificial Sequence
  Synthetic Polypeptide
MDMRVPAQLLGLLLLWLRGARCEVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2036 - protein, 236 aa, Artificial Sequence
  Synthetic Polypeptide
MDMRVPAQLLGLLLLWLRGARCDIQMTQSPSSVSASVGDRVTITCRASQGISNWLAWYQQKPGKAPKLLIFAASSLQSGVPSRFSGSGSGTDFTLTISSLQPEDFATYYCQQAESFPHTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2037 - DNA, 321 bp, Artificial Sequence
  Synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcttaatagttaccctctcactttcggcggagggaccaaggtggagatcaaa

SEQ ID NO: 2038 - DNA, 354 bp, Artificial Sequence
  Synthetic
caggtgcagctggtgcagtctggggctgaagtaaagaagcctggggcctcagtgaaggtgtcctgccaggcttctggatacaccttcaccgactactatatctattgggtgcgacaggcccctggacaagggcttgagtggatgggatggatcaaccctaacagtggtggcacaaactatgcacagaagtttcagggcagggtcaccatgaccagggacacgtccatcagcacagcctacatcgaactgagcaggctgagatctgacgacacggccgtgtattactgtgcgagagaggacaacttcaacggtatggacgtctggggccaagggaccacggtcaccgtgtcctca

SEQ ID NO: 2039 - DNA, 321 bp, Artificial Sequence
  Synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcttaatgcctaccctctcactttcggcggagggaccaaggtggagatcaaa

SEQ ID NO: 2040 - DNA, 354 bp, Artificial Sequence
  Synthetic
caggtgcagctggtgcagtctggggctgaagtaaagaagcctggggcctcagtgaaggtgtcctgcaaggcttctggatacaccttcaccgactactatatctattgggtgcgacaggcccctggacaagggcttgagtggatgggatggatcaaccctaacgccggtggcacaaactatgcacagaagtttcagggcagggtcaccatgaccagggacacgtccatcagcacagcctacatcgaactgagcaggctgagatctgacgacacggccgtgtattactgtgcgagagaggacaacttcaacggtatggacgtctggggccaagggaccacggtcaccgtgtcctca

SEQ ID NO: 2041 - DNA, 321 bp, Artificial Sequence
  Synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctattctgcatccagtttgcaaagtggggtgtcatcaaggttcagcggcagtggatctgggacagagttcactctcacaatcagcagcctgcagcctgaagattttgcaacttattactgtctacagtctaatagttaccctctcactttcggcggagggaccaaggtggagatcaag

SEQ ID NO: 2042 - DNA, 354 bp, Artificial Sequence
  Synthetic
gaggtgcagctggtggagtctgggggaggcttggtacagcctggggggtccctgagactctcctgtgcagcctctggattcaccttcagtagggacgacatgcactgggtccgccaagctacaggaaaaggtctggagtgggtcgcaggtattgataatgctggtgacacatactatccaggctccgtgaagggccgatttaccatctccagagaaaatgccaagaactccttgtatcttcaaatgaacagcctgagagccggggacacggctatttattactgtgcaagagaagggcagtggccctacggtatggacgtctggggccaagggaccacggtcaccgtgtcctca

SEQ ID NO: 2043 - DNA, 321 bp, Artificial Sequence
  Synthetic
gacatccagatgactcagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 2044 - DNA, 351 bp, Artificial Sequence
  Synthetic
gaggtgcagctggtggagtctgggggaggcttggtacagcctggggggtccctgagactctcctgtgcagcctctggattcaccttcagaaactacgacatgcactgggtccgccaagctccaggaaaaggtctggagtgggtgtcagatattggtaattctggtgaaacatattatctaggctccgtgaagggccgattcaccatctccagagaaaatgccaagaactccttgtatcttcaaatgaatagcctgagagccggggacacggctgtgtattattgtgtaagagaggagttcgggtacggtatggacgtctggggccaagggaccacggtcaccgtgtcctca

SEQ ID NO: 2045 - DNA, 321 bp, Artificial Sequence; identical to SEQ ID NO: 2041
  Synthetic

SEQ ID NO: 2046 - DNA, 354 bp, Artificial Sequence
  Synthetic
gaggtgcagctggtggagtctgggggaggcttggtacagcctggggggtccctgagactctcctgtgcagcctctggattcaccttcagtagggacgacatgcactgggtccgccaagctacaggaaaaggtctggagtgggtcgcaggtattgataatgctggtgagacatactatccaggctccgtgaagggccgatttaccatctccagagaaaatgccaagaactccttgtatcttcaaatgaacagcctgagagccggggacacggctatttattactgtgcaagagaagggcagtggccctacggtatggacgtctggggccaagggaccacggtcaccgtgtcctca

SEQ ID NO: 2047 - DNA, 321 bp, Artificial Sequence
  Synthetic
gacatccagatgactcagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcatctgaactacccgctcactttcggcggagggaccaaggtggagatcaaa

SEQ ID NO: 2048 - DNA, 351 bp, Artificial Sequence; identical to SEQ ID NO: 2044
  Synthetic

SEQ ID NO: 2049 - DNA, 321 bp, Artificial Sequence
  .
gacatccagatgactcagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcatctggactacccgctcactttcggcggagggaccaaggtggagatcaaa

SEQ ID NO: 2050 - DNA, 351 bp, Artificial Sequence; identical to SEQ ID NO: 2044
  Synthetic

SEQ ID NO: 2051 - DNA, 321 bp, Artificial Sequence; identical to SEQ ID NO: 2043
  Synthetic

SEQ ID NO: 2052 - DNA, 351 bp, Artificial Sequence
  Synthetic
gaggtgcagctggtggagtctgggggaggcttggtacagcctggggggtccctgagactctcctgtgcagcctctggattcaccttcagaaactacgacatgcactgggtccgccaagctccaggaaaaggtctggagtgggtgtcagatattggtaattctggtgaaacatattatctaggctccgtgaagggccgattcaccatctccagagaaaatgccaagaactccttgtatcttcaaatgaatagcctgagagccggggacacggctgtgtattattgtgtaagagaggagttcccccacggtatggacgtctggggccaagggaccacggtcaccgtgtcctca

SEQ ID NO: 2053 - DNA, 321 bp, Artificial Sequence; identical to SEQ ID NO: 2043
  Synthetic

SEQ ID NO: 2054 - DNA, 351 bp, Artificial Sequence
  Synthetic
gaggtgcagctggtggagtctgggggaggcttggtacagcctggggggtccctgagactctcctgtgcagcctctggattcaccttcagaaactacgacatgcactgggtccgccaagctccaggaaaaggtctggagtgggtgtcagatattggtaattctggtgaaacatattatctaggctccgtgaagggccgattcaccatctccagagaaaatgccaagaactccttgtatcttcaaatgaatagcctgagagccggggacacggctgtgtattattgtgtaagagaggagttccccctgggtatggacgtctggggccaagggaccacggtcaccgtgtcctca

SEQ ID NO: 2055 - DNA, 321 bp, Artificial Sequence
  Synthetic
gagatcgtgatgacccagagccccgccaccctgagcgtgagccccggcgagagggccaccctgagctgcagggccagccagagcgtgagcaacaacctggcctggtaccagcagaagcccggccaggcccccaggctgctgatctacagcgagagcaccagggccaccggcatccccgacaggttcagcggcagcggcagcggcaccgagttcaccctgaccatcagcagcctgcagagcgaggacttcgccgtgtactactgccagcagcacaacaactggcccaggaccttcggccagggcaccaaggtggagatcaag

SEQ ID NO: 2056 - DNA, 387 bp, Artificial Sequence
  Synthetic
caggtgcagctgcaggagagcggccccggcctggtgaagcccagccagaccctgagcctgacctgcaccgtgagcggcggcagcatcagcagcggcggctactactggagctggatcaggcagcaccccggcaagggcctggagtggatcggctacatctactacagcggcagcaccagctacaaccccagcctgaagagcagggtgaccatcagcgtggacaccagcaagaaccagttcagcctgaagctgagcagcgtgaccgccgccgacaccgccgtgtactactgcgccagggacctggactacgacatcctgaccggctaccccaggtgggactacggcatggacgtgtggggccagggcaccaccgtgaccgtgagcagc

SEQ ID NO: 2057 - DNA, 321 bp, Artificial Sequence
  Synthetic
gaaatagtgatgacgcagtctccagccaccctgtctgtgtctccaggggaaagagccaccctctcctgcagggccagtcagagtattagccgcaacttagcctggtaccaacagaaacctggccaggctcccaggctcctcatctatggtgcatccatcagggccactgttatcccagccaggttcagtggcagtgggtctgggacagagttcactctcaccatcagcagcctgcagtctgaagattttgcaatttattactgtcagcagtataataactggatgtgcagttttggccaggggaccaagttggagatcaaa

SEQ ID NO: 2058 - DNA, 366 bp, Artificial Sequence
  Synthetic
caggtgcagctggtggagtctgggggaggcgtggtccagcctgggaggtccctgagactctcctgtgcagcctctggattcaccttcagttactatggcatgcactgggtccgccaggctccaggcaaggggctggagtgggtggcacttatatcatatgatggaaataataaatactatgtagactccgtgaggggccgattcaccatctccagagacaattccaagaacacgctgtctctgcaaatgaacagcctgagagctgaggacacggctgtgtattactgtgcgagagaaatattcggggagtcctattactacggtatggacgtctggggccaagggaccacggtcaccgtctcctca

SEQ ID NO: 2059 - DNA, 321 bp, Artificial Sequence
  Synthetic
gacatccagatgacccactctccatcctccctgtctgcatctataggagacagagtcaccatcacttgccgggcaagtcagggcataagaaatgagttaggctggtatcagaagaaaccagggaaagcccctaagcgcctgatctattctgcatccagtttgcaaagtggggtcccatcaaggttcagcggcagtggatctgggacagaattcactctcacaatcagcagcctgcagcctgaagattttgcaacctattactgtctacaacataatacttaccctctcactttcggcggagggaccaaggtggagatcaaa

SEQ ID NO: 2060 - DNA, 354 bp, Artificial Sequence
  Synthetic
caggtgcagctggtgcagtctgggggagaggtgaagaagcctggggcgtcagtgaaggtctcctgcaaagcttctggattcaccttcaccagttatgacatcaactgggtgcgacaggccacaggacaaggtctggagtggatgggatggatgaaccattacagtggtgattcagattatgcacagaagttgcagggcagagtcatcatcaccaggaacacctccataaccacagcttacatggagctgagcagcctgagatcggaggacacggccgtgtattactgtgggagagagcggtttcccttcggtatggacgtctggggccaagggaccacggtcaccgtctcctca

SEQ ID NO: 2061 - DNA, 321 bp, Artificial Sequence
  Synthetic
gacatccagatgactcagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataataattacccgctcactttcggcggagggaccaaggtggagatcaaa

SEQ ID NO: 2062 - DNA, 351 bp, Artificial Sequence
  Synthetic
gaggtgcagctggtggagtctgggggaggcttggtacagcctggggggtccctgagactctcctgtgcagcctctggattcaccttcagaaactacgacatgcactgggtccgccaagttccaggaaaaggtctggagtgggtctcagatattggtaattctggtgaaacatattatctaggctccgtgaagggccgattcaccatctccagagaaaatgccaagaactccttgtatcttcaaatgaatagcctgagagccggggacacggctgtgtattattgtgtaagagaggagttcgggaacggtatggacgtctggggccaagggaccacggtcaccgtctcctca

SEQ ID NO: 2063 - DNA, 321 bp, Artificial Sequence
  Synthetic
gacatccagatgactcagtctccatcctccctgtctgcatctgtaggagacagagtcaccatcacttgccgggcaagtcagggcattagaagtgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaggattttgcaacttattactgtcttcagcataatagttacccgttcactttcggcggagggaccaaggtggagatcaaa

SEQ ID NO: 2064 - DNA, 351 bp, Artificial Sequence
  Synthetic
gaggtgcagctggtggagtctgggggaggcttggtacagcctggggggtccctgagactctcctgtgcagcctctggattcaccttcagtaactacgacatgcactgggtccgccaagctacaggaaaaggtctggagtgggtctcagatattggtaatgctggtgaaacatattatctagactccgtgaagggccgattcaccatctccagagaaaatgccaagaactccttgtatcttcaaatgaatagcctgagagccggggacacggctgtgtattattgtgtaagagaggagttcgggcacggtatggacgtctggggccaagggaccacggtcaccgtctcctca

SEQ ID NO: 2065 - DNA, 321 bp, Artificial Sequence
  Synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccactttgcaaagtggggtctcatcaaggttcagcggcagtggatctgggacagaattcactctcacaatcagcagcctgcagcctgaagattttgcaacttattactgtctacagcataatagttaccctctcactttcggcggagggaccaaggtggagatcaaa

SEQ ID NO: 2066 - DNA, 354 bp, Artificial Sequence
  Synthetic
gaggtgcagctggtggagtctgggggaggcttggtacagcctggggggtccctgagactctcctgtgcagcctctggattcaccttcagtagggacgacatgcactgggtccgccaagctacaggaaaaggtctggagtgggtcgcagccattgataatgctggtgacacatactatccaggctccgtgaagggccgattcaccatctccagagaaaatgccaagaactccttgtatcttcaaatgaacagcctgagagccggggacacggctgtgtattactgtgcaagagaggggcagtggccctacggtatggacgtctggggccaagggaccacggtcaccgtctcctca

SEQ ID NO: 2067 - DNA, 330 bp, Artificial Sequence
  Synthetic
caggccgccctgacccagcccgccagcgtgagcggcagccccggccagagcatcaccatcagctgcaccggcaacgccaacaacgtgggcaacaggggcgccgcctggctgcagcagcaccccggcaaggcccccaagctgatgatctacaggaacaacaacaggcccagcggcgtgagcaacaggttcagcgccagcaggagcggcaacaccgccagcctgaccatcagcggcctgcaggccgaggacgaggccgactactactgcagcgcctgggacagcagcctgagcgcctgggtgttcggcggcggcaccaagctgaccgtgctg

SEQ ID NO: 2068 - DNA, 366 bp, Artificial Sequence
  Synthetic
gaggtgcagctgctggagagcggcggcggcctggtgcagcccggcggcagcctgaggctgagctgcgccgccagcggcttcaccttcagcagctacggcatgcactgggtgaggcaggcccccggcaagggcctggagtgggtgagcctgatctggttcgacgagagcaacatctactacgccgacagcgtgaagggcaggttcaccatcagcagggacaacgccaagaacaccctgtacctgcagatgaacagcctgagggccgaggacaccgccgtgtacttctgcgccaggggctacgacctgctgaccggctactacaacttcgacttctggggccagggcaccctggtgaccgtgagcagc

SEQ ID NO: 2069 - DNA, 324 bp, Artificial Sequence
  Synthetic
gaaattgtgttgacgcagtctccaggcaccctgtctttgtctccaggggaaagagccaccctctcctgcagggccagtcagcccgttgccagcgtgtacttagcctggtaccagcagaaacctggccaggctcccaggctcctcttctatggtgcatccagcagggccactggcatcccagacaggttcagtcgcagtgggtctgggacagacttcactctcaccatcagcagactggagcctgaagattttgcagtgtattactgtcaacagtatgatgtctcaccgtggacgttcggccaagggaccaaggtagaaatcaaa

SEQ ID NO: 2070 - DNA, 369 bp, Artificial Sequence
  Synthetic
caggtgcagctgcaggagtcgggcccaggactggtgaagccttcagaaaccctgtccctcacctgcactgtctctggtggctccatcagcagtggtggttactactggaactggatccgccagcccccagggaagggcctggagtggattgggtacatctatggccgcgggagcaccttctacaacccgtccctcaagagtcgagttaccatctcagtagacacgtctaagaaccagttctccctgaagctgagctctgtgactgccgcggacacggccgtgtattactgtgcgagagcccctcggtataactggaactacggctggttcgacccctggggccagggaaccctggtcaccgtgtcctca

SEQ ID NO: 2071 - DNA, 336 bp, Artificial Sequence
  Synthetic
gaaattgtgctgacccagactcccctctctctgtccgtcacccctggacagccggcctccatctcctgcaagtctagtcagagcctcctgcctagtgatggaaagacctatttgtcttggtacctgcagaagccaggcctgcctccacaggtcctgatctatgaagtttccaaccggttctctggagtgccagataggttcagtggcagcgggtcagggacagatttcacactgaaaatcagtcgggtggaggctgaggatgttggggtttattactgcatgcaaagcatccaacttccgctcactttcggcggagggaccaaggtggagatcaaa

SEQ ID NO: 2072 - DNA, 381 bp, Artificial Sequence
  Synthetic
caggtgcagctgcaggagtcgggcccaggactggtgaacccttcacagaccctgtccctcacctgcattgtctctggtggctccatcagaagtggtgattactactggagttggatccgccagcaccctgggaagggcctggagtggattgggtacatctattacagtgggggcacctactacaacccgtccctcaagagtcgagttatcatctcagtagacacgactaagaaccagttctccctgaagctgagttctatgactgccgcggacacggccgtgtattattgtgcgcgagggagtatcgcagctcgttcgggatacttctacttctccggtttggacgtctggggccaagggcccacggtcaccgtgtcctca

SEQ ID NO: 2073 - DNA, 321 bp, Artificial Sequence
  Synthetic
gacatccagatgacccagtctccatcctccctgtctgcatctgtaggagacagagtcaccatcacttgccgggcaagtcagaacattagaaggtatttaaattggtatcagcagaaaccaggaaaagcccctgagctcctgatctattctgcatccaatttacaaaatggagtcccatcaaggttcagtggcagtggatctgggacagatttcactctcaccatcagcagtctgcaacctgaagattttgcaacttactactgtcaacagagttacattatccctccgacgttcggccaagggaccaaggtggagatcaga

SEQ ID NO: 2074 - DNA, 366 bp, Artificial Sequence
  Synthetic
caggtgcagctggtgcagtctggggctgaggtgaagaagcctggggcctcagtgaaagtttcctgcaaggcatctggatacactttcaccagctactatatccactgggtgcgacaggcccctggacaagggcttgagtggatgggaatcatcaaccctagtggaggtcgcacaagctacgcacagatgttccagggcagagtcaccctgaccagggacacgtccacgaacacagtctacatggagctgagcagcctgagatctgaggacacggccgtgttttactgtgcgaaagatcgcgaggagcagtggccggtagggggatttgactactggggccagggaaccctggtcaccgtgtcctca

SEQ ID NO: 2075 - DNA, 321 bp, Artificial Sequence
  Synthetic
gacattcagatgacccagtctccatcctccctgtctgcatctgtaggagacagagtcaccatcacttgccgggcaagtcagagcattagaaggtatttaaattggtatcaacagatcccagggaaagcccctaagttcctgatctatgatgcatccagtttgcaaagtggggtcccatcaaggttcagtggcagtggatctgggacagatttcactctcaccatcagcagtctgcaacctgaagattttgcaacttactactgtcaacagagttacagtacccctccgacgttcggccaagggaccaaggtggaaatcaaa

SEQ ID NO: 2076 - DNA, 369 bp, Artificial Sequence
  Synthetic
caggtgcagctgcaggagtcgggcccaggactggtgaagccttcggagaccctgttcctcacctgcactgtctctggtggctccgtcactaattactactggagctggatccggcagcccgccgggaagggactggaatggattggacgtatctataccagtgggagcacctactacaacccctccctcaagagtcgagtcaccatgtccctagacacgtccaagaaccagttctccctgaggctgagctctgtgaccgccgcggacacggccgtgtattactgtgcgagagaagggtttactatggttcggggagttatgggtgcttttgatatctggggccaagggacaatggtcaccgtgtcttca

SEQ ID NO: 2077 - DNA, 321 bp, Artificial Sequence
  Synthetic
gacatcgagatgacccaggctccatcctccctgtctgcatctgtaggggacagagtcaccatcacttgccgggcaagtcagactattagaaggtatttaaattggtatcagcagaaaccagggaaagcccctaagctcctgatctatgctgcatccagtttgcaaaatggggtcccatcaaggttcagtggcagtgtatctgggacagatttcactctcaccatcagcagtctgcaacctgaggattttgcaacctactattgtcaacagagttacagtaccccgctcactttcggcggagggaccaaggtgggtatcaga

SEQ ID NO: 2078 - DNA, 366 bp, Artificial Sequence
  Synthetic
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatgggatggatcagccctaccagtggtgccacaggctatgcacagaactttcagggcagggtcaccatgaccagggacacgtccatcaccacagcctacatggaactgagcaggctgagatctgacgatacggccgtttattactgtgcgagagatagcaactcggtcctttattactacggtatggacgtctggggccaagggaccacggtcaccgtgtcctca

SEQ ID NO: 2079 - DNA, 321 bp, Artificial Sequence
  Synthetic
gacatccagatgacccagtctccatcctccctgtctgcatctgtaggagacagagtcaccatcacttgccggtcaagtcagtccattagcagctatttaaactggtatcaacagaagccagggagagcccctaaactcctgatccatgctgcatccagtttgcaaagtggggtcccatcaaggttcagtggcagtggatctgggacagatttcactctcaccatcagcagtctccaacctgaagattttgcatcttactgctgtcaacagagttacactacccctcctactttcggcggagggaccaaagtggagatcaaa

SEQ ID NO: 2080 - DNA, 360 bp, Artificial Sequence
  Synthetic
caggtgcaactgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagggggggcacctactacaacccgtccctcaggagtcgagttaccatgtcagtagacacgtctaagaaccagttctccctgatgttgagctctgtgactgccgcggacacggccgtgtattactgtgcgagaacgatttttggagtgattattcttgacaactggggccagggaaccccggtcaccgtgtcctca

SEQ ID NO: 2081 - DNA, 330 bp, Artificial Sequence
  Synthetic
caggcagggctgactcagccaccctcggtgtccaagggcttgagacagaccgccacactcacctgcactgggaacaccaacaatgttggcaaccgaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagttgaccgtccta

SEQ ID NO: 2082 - DNA, 366 bp, Artificial Sequence
  Synthetic
caggtgcaactggtagagtctgggggaggcgtggtccagcctgggaggtccctgagactctcctgtgcagcgtctggattcaccttcagtagctatggcatgcactgggtccgccaggctcctggcaaggggctggagtgggtggcacttatctggtttgatgaaagtaatatctactatgcagactccgtgaagggccgattcaccatctccagagacaattccaagaacacgctgtatctgcaaatgaacagcctgagagccgaggacacggctgtatatttctgtgcgagaggttacgatcttttgactggttattataattttgacttctggggcctgggaaccctggtcaccgtgtccgca

SEQ ID NO: 2083 - DNA, 321 bp, Artificial Sequence
  Synthetic
gaaattgtgctgactcagtctccagactttcagtctgtgactccaaaggagaaagtcgccatcacctgccgggccagtcagagcattgggagtagcttacactggtaccagcagaaaccagatcagtctccaaagcccctcatcaagtatgtttcccagtccttctcaggggtcccctcgaggttcagtggcagtggatctgggacagatttcaccctcaccatcaatagcctggaagctgaagatgctgcaacgtattactgtcatcagagtagtagtttacctctcactttcggcggagggaccaaggtggagatcaaa

SEQ ID NO: 2084 - DNA, 381 bp, Artificial Sequence
  Synthetic
caggtgcagctgcaggagtcgggcccgggactggtgaagccttcacagaccctgtccctcacctgcactgtctctggtggctccatcagtagtgtttatttttactggaattggatccgccagcacccagggaagggcctggagtggattgggtacatctattacagtgggggcacctactacaacccgtccctcaggagtcgggttaccatctcagtagacacgtctaagaaccagttctccctgaagctgaattctgtgactgccgcggacacggccgtgtattactgtgcgagaggctcaatcgcagcaggtggagggtatttctactacaacgatatggacgtctggggccaagggaccacggtcaccgtgtcctca

SEQ ID NO: 2085 - DNA, 321 bp, Artificial Sequence
  Synthetic
gacatccagatgacccagtctccatcctccctgtctgcatctgtaggagacagagtcaccatcacttgccggtcaagtcagtccattagcagctatttaaactggtatcaacagaagccagggagagcccctaaactcctgatctatgctgcatccagtttgcaaagtggggtcccatcaaggttcagtggcagtggatctgggacagatttcactctcaccatcagcagtctccaacctgaagattttgcatcttactactgtcaacagagttacactacccctcctactttcggcggagggaccaaagtggagatcaaa

SEQ ID NO: 2086 - DNA, 360 bp, Artificial Sequence
  Synthetic
caggtgcaactgcaggagtcgggcccaggactggtgaagccttcagagaccctgtccctcacctgcactgtctctggtggctccatcagcagtggtggttactactggagctggatccgccagcacccagggaagggcctggagtggattgggtacatctattacagggggggcacctactacaacccgtccctcaggagtcgagttaccatgtcagtagacacgtctaagaaccagttctccctgaggttgagctctgtgactgccgcggacacggccgtgtattactgtgcgagaacgatttttggagtgattattcttgacaactggggccagggaaccccggtcaccgtgtcctca

SEQ ID NO: 2087 - DNA, 324 bp, Artificial Sequence
  Synthetic
gaaattgtgttgacgcagtctccaggcaccctgtctttgtctccaggggaaagagccaccctctcctgcagggccagtcagcaagttagcagcacctacttagcctggtaccagcagaaacctggccaggctcccaggctcctcttctatggtgcatccagcagggccactggcatcccagacaggttcagtcgcagtgggtctgggacagacttcactctcaccatcagcagactggagcctgaagattttgcagtgtattactgtcaacagtatgatgtctcaccgtggacgttcggccaagggaccaaggtagaaatcaaa

SEQ ID NO: 2088 - DNA, 369 bp, Artificial Sequence
  Synthetic
caggtgcagctgcaggagtcgggcccaggactggtgaagccttcagagaccctgtccctcacctgcactgtctctggtggctccatcagcagtggtggttactactggaactggatccgccagcccccagggaagggcctggagtggattgggtacatctattacagtgggagcaccttctacaacccgtccctcaagagtcgagttaccatctcagtagacacgtctaagaaccagttctccctgaagctgagctctgtgactgccgcggacacggccgtgtattactgtgcgagagcccctcggtataactggaactacggctggttcgacccctggggccagggaaccctggtcaccgtgtcctca

SEQ ID NO: 2089 - DNA, 321 bp, Artificial Sequence; identical to SEQ ID NO: 2083
  Synthetic

SEQ ID NO: 2090 - DNA, 381 bp, Artificial Sequence
  Synthetic
caggtgcagctgcaggagtcgggcccgggactggtgaagccttcagagaccctgtccctcacctgcactgtctctggtggctccatcagtagtgtttatttttactggaattggatccgccagcccccagggaagggcctggagtggattgggtacatctattacagtgggggcacctactacaacccgtccctcaggagtcgggttaccatctcagtagacacgtctaagaaccagttctccctgaagctgaattctgtgactgccgcggacacggccgtgtattactgtgcgagaggctcaatcgcagcaggtggagggtatttctactacaacgatatggacgtctggggccaagggaccacggtcaccgtgtcctca

SEQ ID NO: 2091 - DNA, 324 bp, Artificial Sequence
  Synthetic
gaaattgtgttgacgcagtctccaggcaccctgtctttgtctccaggggaaagagccaccctctcctgcagggccagtcagaatgttagcagcacctacttagcctggtaccagcagaaacctggccaggctcccaggctcctcttctatggtgcatccagcagggccactggcatcccagacaggttcagtcgcagtgggtctgggacagacttcactctcaccatcagcagactggagcctgaagattttgcagtgtattactgtcaacagtatgatgtctcaccgtggacgttcggccaagggaccaaggtagaaatcaaa

SEQ ID NO: 2092 - DNA, 369 bp, Artificial Sequence
  Synthetic
caggtgcagctgcaggagtcgggcccaggactggtgaagccttcacagaccctgtccctcacctgcactgtctctggtggctccatcagcagtggtggttactactggaactggatccgccagcacccagggaagggcctggagtggattgggtacatctattacagtgggagcaccttctacaacccgtccctcaagagtcgagttatcatatcagtagacacgtctaagaaccagttctccctgaagctgagctctgtgactgccgcggacacggccgtgtattactgtgcgagagcccctcggtataactggaactacggctggttcgacccctggggccagggaaccctggtcaccgtctcctca

SEQ ID NO: 2093 - protein, 450 aa, Artificial Sequence
  Synthetic
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2094 - protein, 214 aa, Artificial Sequence
  Synthetic
DIQMTQSPSSVSASVGDRVTITCRASQGISNWLAWYQQKPGKAPKLLIFAASSLQSGVPSRFSGSGSGTDFTLTISSLQPEDFATYYCQQAESFPHTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

What is claimed:

1. A CD112R antigen-binding protein comprising a heavy chain (HC) complementarity-determining region (CDR) 1, HC CDR2, HC CDR3, light chain (LC) CDR1, LC CDR2, and LC CDR3 comprising the amino acid sequences selected from the group consisting of: (a) SEQ ID NOs: 13-18, respectively; (b) SEQ ID NOs: respectively; (c) SEQ ID NOs: 33-38, respectively; (d) SEQ ID NOs: 43-48, respectively; (e) SEQ ID NOs: 53-58, respectively; (f) SEQ ID NOs: 63-68, respectively; (g) SEQ ID NOs: 73-78, respectively; (h) SEQ ID NOs: 83-88, respectively; (i) SEQ ID NOs: 93-98, respectively; (j) SEQ ID NOs: 103-108, respectively; (k) SEQ ID NOs: 233-238, respectively; (l) SEQ ID NOs: 1973-1978, respectively; (m) SEQ ID NOs: 1983-1988, respectively; (n) SEQ ID NOs: 1993-1998, respectively; and (o) SEQ ID NOs: 2003-2008, respectively.

2. The CD112R antigen-binding protein of claim 1, comprising (I) a HC variable region and LC variable region comprising the amino acid sequences selected from the group consisting of: (a) SEQ ID NOs: 11-12, respectively; (b) SEQ ID NOs: 21-22, respectively; (c) SEQ ID NOs: 31-32, respectively; (d) SEQ ID NOs: 41-42, respectively; (e) SEQ ID NOs: 51-52, respectively; (f) SEQ ID NOs: 61-62, respectively; (g) SEQ ID NOs: 71-72, respectively; (h) SEQ ID NOs: 81-82, respectively; (i) SEQ ID NOs: 91-92, respectively; (j) SEQ ID NOs:101-102, respectively; (k) SEQ ID NOs: 231-232, respectively; (l) SEQ ID NOs: 1971-1972, respectively; (m) SEQ ID NOs: 1981-1982, respectively; (n) SEQ ID NOs: 1991-1992, respectively; and (o) SEQ ID NOs: 2001-2002, respectively, or (II) (a) a HC variable region comprising an amino acid sequence having at least 90% sequence identity to SEQ ID NO: 11 and a LC variable region comprising an amino acid sequence having at least 90% sequence identity to SEQ ID NO: 12; (b) a HC variable region comprising an amino acid sequence having at least 90% sequence identity to SEQ ID NO: 21 and a LC variable region comprising an amino acid sequence having at least 90% sequence identity to SEQ ID NO: 22; (c) a HC variable region comprising an amino acid sequence having at least 90% sequence identity to SEQ ID NO: 31 and a LC variable region comprising an amino acid sequence having at least 90% sequence identity to SEQ ID NO: 32; (d) a HC variable region comprising an amino acid sequence having at least 90% sequence identity to SEQ ID NO: 41 and a LC variable region comprising an amino acid sequence having at least 90% sequence identity to SEQ ID NO: 42; (e) a HC variable region comprising an amino acid sequence having at least 90% sequence identity to SEQ ID NO: 51 and a LC variable region comprising an amino acid sequence having at least 90% sequence identity to SEQ ID NO: 52; (f) a HC variable region comprising an amino acid sequence having at least 90% sequence identity to SEQ ID NO: 61 and a LC variable region comprising an amino acid sequence having at least 90% sequence identity to SEQ ID NO: 62; (g) a HC variable region comprising an amino acid sequence having at least 90% sequence identity to SEQ ID NO: 71 and a LC variable region comprising an amino acid sequence having at least 90% sequence identity to SEQ ID NO: 72; (h) a HC variable region comprising an amino acid sequence having at least 90% sequence identity to SEQ ID NO: 81 and a LC variable region comprising an amino acid sequence having at least 90% sequence identity to SEQ ID NO: 82; (i) a HC variable region comprising an amino acid sequence having at least 90% sequence identity to SEQ ID NO: 91 and a LC variable region comprising an amino acid sequence having at least 90% sequence identity to SEQ ID NO: 92; (j) a HC variable region comprising an amino acid sequence having at least 90% sequence identity to SEQ ID NO: 101 and a LC variable region comprising an amino acid sequence having at least 90% sequence identity to SEQ ID NO: 102; (k) a HC variable region comprising an amino acid sequence having at least 90% sequence identity to SEQ ID NO: 231 and a LC variable region comprising an amino acid sequence having at least 90% sequence identity to SEQ ID NO: 232; (l) a HC variable region comprising an amino acid sequence having at least 90% sequence identity to SEQ ID NO: 1971 and a LC variable region comprising an amino acid sequence having at least 90% sequence identity to SEQ ID NO: 1972; (m) a HC variable region comprising an amino acid sequence having at least 90% sequence identity to SEQ ID NO: 1981 and a LC variable region comprising an amino acid sequence having at least 90% sequence identity to SEQ ID NO: 1982; (n) a HC variable region comprising an amino acid sequence having at least 90% sequence identity to SEQ ID NO: 1991 and a LC variable region comprising an amino acid sequence having at least 90% sequence identity to SEQ ID NO: 1992; (o) a HC variable region comprising an amino acid sequence having at least 90% sequence identity to SEQ ID NO: 2001 and a LC variable region comprising an amino acid sequence having at least 90% sequence identity to SEQ ID NO: 2002.

3. A CD112R antigen-binding protein comprising a HC and LC comprising the amino acid sequences selected from the group consisting of: (a) SEQ ID NOs: 9-10, respectively; (b) SEQ ID NOs: 19-20, respectively; (c) SEQ ID NOs: 29-30, respectively; (d) SEQ ID NOs: 39-40, respectively; (e) SEQ ID NOs: 49-50, respectively; (f) SEQ ID NOs: 59-60, respectively; (g) SEQ ID NOs: 69-70, respectively; (h) SEQ ID NOs: 79-80, respectively; (i) SEQ ID NOs: 89-90, respectively; (j) SEQ ID NOs: 99-100, respectively; (k) SEQ ID NOs: 229-230, respectively; (l) SEQ ID NOs: 1969-1970, respectively; (m) SEQ ID NOs: 1979-1980, respectively; (n) SEQ ID NOs: 1989-1990, respectively; (o) SEQ ID NOs: 1999-2000, respectively; (p) SEQ ID NOs: 241-242, respectively; (q) SEQ ID NOs: 247-248, respectively; (r) SEQ ID NOs: 249-250, respectively; (s) SEQ ID NOs: 251-252, respectively; and (t) SEQ ID NOs: 263-264 respectively.

4. The CD112R antigen-binding protein of claim 1, which is an antibody.

5. The CD112R antigen-binding protein of claim 1, which is an antigen-binding fragment of an antibody.

6. The CD112R antigen-binding protein of claim 1, which is an antibody protein product.

7. A TIGIT antigen-binding protein comprising a heavy chain (HC) complementarity-determining region (CDR) 1, HC CDR2, HC CDR3, light chain (LC) CDR1, LC CDR2, and LC CDR3 comprising the amino acid sequences selected from the group consisting of: (a) SEQ ID NOs: 113-118, respectively; (b) SEQ ID NOs: 123-128, respectively; (c) SEQ ID NOs: 133-138, respectively; (d) SEQ ID NOs: 143-148, respectively; (e) SEQ ID NOs: 153-158, respectively; (f) SEQ ID NOs: 163-168, respectively; (g) SEQ ID NOs: 173-178, respectively; (h) SEQ ID NOs: 183-188, respectively, (i) SEQ ID NOs: 193-198, respectively; (j) SEQ ID NOs: 203-208, respectively; (k) SEQ ID NOs: 213-218, respectively; (l) SEQ ID NOs: 223-228, respectively; and (m) SEQ ID NOs: 2013-2018, respectively.

8. The TIGIT antigen-binding protein of claim 7, comprising (I) a HC variable region and LC variable comprising the amino acid sequences are selected from the group consisting of: (a) SEQ ID NOs: 111-112, respectively; (b) SEQ ID NOs: 121-122, respectively; (c) SEQ ID NOs:

131-132, respectively; (d) SEQ ID NOs: 141-142, respectively; (e) SEQ ID NOs: 151-152, respectively; (f) SEQ ID NOs: 161-162, respectively; (g) SEQ ID NOs: 171-172, respectively; (h) SEQ ID NOs: 181-182, respectively; (i) SEQ ID NOs: 191-192, respectively; (j) SEQ ID NOs: 201-202, respectively; (k) SEQ ID NOs: 211-212, respectively; (l) SEQ ID NOs: 221-222, respectively; and (m) SEQ ID NOs: 2011-2012, respectively or (II) a HC variable region comprising an amino acid sequence having at least 90% sequence identity to SEQ ID NO: 111 and a LC variable region comprising an amino acid sequence having at least 90% sequence identity to SEQ ID NO: 112; (b) a HC variable region comprising an amino acid sequence having at least 90% sequence identity to SEQ ID NO: 121 and a LC variable region comprising an amino acid sequence having at least 90% sequence identity to SEQ ID NO: 122; (c) a HC variable region comprising an amino acid sequence having at least 90% sequence identity to SEQ ID NO: 131 and a LC variable region comprising an amino acid sequence having at least 90% sequence identity to SEQ ID NO: 132; (d) a HC variable region comprising an amino acid sequence having at least 90% sequence identity to SEQ ID NO: 141 and a LC variable region comprising an amino acid sequence having at least 90% sequence identity to SEQ ID NO: 142, (e) a HC variable region comprising an amino acid sequence having at least 90% sequence identity to SEQ ID NO: 151 and a LC variable region comprising an amino acid sequence having at least 90% sequence identity to SEQ ID NO: 152; (f) a HC variable region comprising an amino acid sequence having at least 90% sequence identity to SEQ ID NO: 161 and a LC variable region comprising an amino acid sequence having at least 90% sequence identity to SEQ ID NO: 162; (g) a HC variable region comprising an amino acid sequence having at least 90% sequence identity to SEQ ID NO: 171 and a LC variable region comprising an amino acid sequence having at least 90% sequence identity to SEQ ID NO: 172; (h) a HC variable region comprising an amino acid sequence having at least 90% sequence identity to SEQ ID NO: 181 and a LC variable region comprising an amino acid sequence having at least 90% sequence identity to SEQ ID NO: 182; (i) a HC variable region comprising an amino acid sequence having at least 90% sequence identity to SEQ ID NO: 191 and a LC variable region comprising an amino acid sequence having at least 90% sequence identity to SEQ ID NO: 192; (j) a HC variable region comprising an amino acid sequence having at least 90% sequence identity to SEQ ID NO: 201 and a LC variable region comprising an amino acid sequence having at least 90% sequence identity to SEQ ID NO: 202; (k) a HC variable region comprising an amino acid sequence having at least 90% sequence identity to SEQ ID NO: 211 and a LC variable region comprising an amino acid sequence having at least 90% sequence identity to SEQ ID NO: 212; (l) a HC variable region comprising an amino acid sequence having at least 90% sequence identity to SEQ ID NO: 221 and a LC variable region comprising an amino acid sequence having at least 90% sequence identity to SEQ ID NO: 222; (m) a HC variable region comprising an amino acid sequence having at least 90% sequence identity to SEQ ID NO: 2011 and a LC variable region comprising an amino acid sequence having at least 90% sequence identity to SEQ ID NO: 2012.

9. A TIGIT antigen-binding protein comprising a HC and LC comprising the amino acid sequences selected from the group consisting of: (a) SEQ ID NOs: 109-110, respectively; (b) SEQ ID NOs: 119-120, respectively; (c) SEQ ID NOs: 129-130, respectively; (d) SEQ ID NOs: 139-140, respectively; (e) SEQ ID NOs: 149-150, respectively; (f) SEQ ID NOs: 159-160, respectively; (g) SEQ ID NOs: 169-170, respectively; (h) SEQ ID NOs: 179-180, respectively; (i) SEQ ID NOs: 189-190, respectively; (j) SEQ ID NOs: 199-200, respectively; (k) SEQ ID NOs: 209-210, respectively; (l) SEQ ID NOs: 219-220, respectively; (m) SEQ ID NOs: 2009-2010, respectively; (n) SEQ ID NOs: 239-240, respectively; (o) SEQ ID NOs: 243-244, respectively; (p) SEQ ID NOs: 245-246, respectively; (q) SEQ ID NOs: 253-254, respectively; (r) SEQ ID NOs: 255-256, respectively; (s) SEQ ID NOs: 257-258, respectively; (t) SEQ ID NOs: 259-260, respectively; and (u) SEQ ID NOS: 261-262 respectively.

10. The TIGIT antigen-binding protein of claim 7, which is an antibody.

11. The TIGIT antigen-binding protein of claim 7, which is an antigen-binding fragment of an antibody.

12. The TIGIT antigen-binding protein of claim 7, which is an antibody protein product.

13. A composition comprising a CD112R antigen binding protein and a TIGIT antigen binding protein wherein (I) the CD112R antigen binding protein comprises a heavy chain (HC) complementarity-determining region (CDR) 1, HC CDR2, HC CDR3, light chain (LC) CDR1, LC CDR2, and LC CDR3 comprising the amino acid sequences selected from the group consisting of: (a) SEQ ID NOs: 13-18, respectively; (b) SEQ ID NOs: 23-28, respectively; (c) SEQ ID NOs: 33-38, respectively; (d) SEQ ID NOs: 43-48, respectively; (e) SEQ ID NOs: 53-58, respectively; (f) SEQ ID NOs: 63-68, respectively; (g) SEQ ID NOs: 73-78, respectively; (h) SEQ ID NOs: 83-88, respectively; (i) SEQ ID NOs: 93-98, respectively; (j) SEQ ID NOs: 103-108, respectively; (k) SEQ ID NOs: 233-238, respectively; (l) SEQ ID NOs: 1973-1978, respectively; (m) SEQ ID NOs: 1983-1988, respectively; (n) SEQ ID NOs: 1993-1998, respectively; and (o) SEQ ID NOs: 2003-2008, respectively; and/or (II) the TIGIT antigen binding protein comprises a heavy chain (HC) complementarity-determining region (CDR) 1, HC CDR2, HC CDR3, light chain (LC) CDR1, LC CDR2, and LC CDR3 comprising the amino acid sequences selected from the group consisting of: (a) SEQ ID NOs: 113-118, respectively; (b) SEQ ID NOs: 123-128, respectively; (c) SEQ ID NOs: 133-138, respectively; (d) SEQ ID NOs: 143-148, respectively; (e) SEQ ID NOs: 153-158, respectively; (f) SEQ ID NOs: 163-168, respectively; (g) SEQ ID NOs: 173-178, respectively; (h) SEQ ID NOs: 183-188, respectively; (i) SEQ ID NOs: 193-198, respectively; (j) SEQ ID NOs: 203-208, respectively; (k) SEQ ID NOs: 213-218, respectively; (l) SEQ ID NOs: 223-228, respectively; and (m) SEQ ID NOs: 2013-2018, respectively.

14. The composition of claim 13, wherein (A) the CD112R antigen binding protein comprises a heavy chain and light chain comprising the amino acid sequences selected from the group consisting of: (a) SEQ ID NOs: 9-10, respectively; (b) SEQ ID NOs: 19-20, respectively; (c) SEQ ID NOs: 29-30, respectively; (d) SEQ ID NOs: 39-40, respectively; (e) SEQ ID NOs: 49-50, respectively; (f) SEQ ID NOs: 59-60, respectively; (g) SEQ ID NOs: 69-70, respectively; (h) SEQ ID NOs: 79-80, respectively; (i) SEQ ID NOs: 89-90, respectively; (j) SEQ ID NOs: 99-100, respectively; (k) SEQ ID NOs: 229-230, respectively; (l) SEQ ID NOs: 1969-1970, respectively; (m) SEQ ID NOs: 1979-1980, respectively; (n) SEQ ID NOs: 1989-1990, respectively; (o) SEQ ID NOs: 1999-2000, respectively; (p) SEQ ID NOs: 241-242, respectively; (q) SEQ ID NOs: 247-248, respectively; (r) SEQ ID NOs: 249-250, respectively; (s) SEQ ID NOs: 251-252, respectively; and (t) SEQ ID NOs: 263-264, respectively; (B) the TIGIT antigen binding protein comprises the amino acid sequences selected from the group consisting of: (a) SEQ ID NOs: 109-110, respectively; (b) SEQ ID NOs: 119-120, respectively; (c) SEQ ID NOs: 129-130, respectively; (d) SEQ ID NOs: 139-140, respectively; (e) SEQ ID NOs: 149-150, respectively; (f) SEQ ID NOs: 159-160, respectively; (g) SEQ ID NOs: 169-170, respectively; (h) SEQ ID NOs: 179-180, respectively; (i) SEQ ID NOs: 189-190, respectively; (j) SEQ ID NOs: 199-200, respectively; (k) SEQ ID NOs: 209-210, respectively; (l) SEQ ID NOs: 219-220, respectively; (m) SEQ ID NOs: 2009-2010, respectively; (n) SEQ ID NOs: 239-240, respectively; (o) SEQ ID NOs: 243-244, respectively; (p) SEQ ID NOs: 245-246, respectively; (q) SEQ ID NOs: 253-254, respectively; (r) SEQ ID NOs: 255-256, respectively; (s) SEQ ID NOs: 257-258, respectively; (t) SEQ ID NOs: 259-260, respectively; and (u) SEQ ID NOS: 261-262 respectively; or (C) the composition comprises a combination of (A) and (B).

15. The composition of claim 14, wherein the composition comprises (A) a CD112R antigen binding protein comprising a HC amino acid sequence of SEQ ID NO: 29 and a LC amino acid sequence of SEQ ID NO: 30 and a TIGIT antigen binding protein comprising a HC amino acid sequence of SEQ ID NO: 199 and a LC amino acid sequence of SEQ ID NO: 200, (B) a CD112R antigen binding protein comprising a HC amino acid sequence of SEQ ID NO: 29 and a LC amino acid sequence of SEQ ID NO: 30 and a TIGIT antigen binding protein comprising a HC amino acid sequence of SEQ ID NO: 219 and a LC amino acid sequence of SEQ ID NO: 2202, (C) a CD112R antigen binding protein comprising a HC amino acid sequence of SEQ ID NO: 59 and a LC amino acid sequence of SEQ ID NO: 60 and a TIGIT antigen binding protein comprising a HC amino acid sequence of SEQ ID NO: 199 and a LC amino acid sequence of SEQ ID NO: 2002, (D) a CD112R antigen binding protein comprising a HC amino acid sequence of SEQ ID NO: 59 and a LC amino acid sequence of SEQ ID NO: 60 and a TIGIT antigen binding protein comprising a HC amino acid sequence of SEQ ID NO: 219 and a LC amino acid sequence of SEQ ID NO: 220, (E) a CD112R antigen binding protein comprising a HC amino acid sequence of SEQ ID NO: 79 and a LC amino acid sequence of SEQ ID NO: 80 and a TIGIT antigen binding protein comprising a HC amino acid sequence of SEQ ID NO: 199 and a LC amino acid sequence of SEQ ID NO: 2002, (F) a CD112R antigen binding protein comprising a HC amino acid sequence of SEQ ID NO: 79 and a LC amino acid sequence of SEQ ID NO: 80 and a TIGIT antigen binding protein comprising a HC amino acid sequence of SEQ ID NO: 219 and a LC amino acid sequence of SEQ ID NO: 2202, (G) a CD112R antigen binding protein comprising a HC amino acid sequence of SEQ ID NO: 19 and a LC amino acid sequence of SEQ ID NO: 20 and a TIGIT antigen binding protein comprising a HC amino acid sequence of SEQ ID NO: 199 and a LC amino acid sequence of SEQ ID NO: 200, (H) a CD112R antigen binding protein comprising a HC amino acid sequence of SEQ ID NO: 39 and a LC amino acid sequence of SEQ ID NO: 40 and a TIGIT antigen binding protein comprising a HC amino acid sequence of SEQ ID NO: 199 and a LC amino acid sequence of SEQ ID NO: 200, (I) a CD112R antigen binding protein comprising a HC amino acid sequence of SEQ ID NO: 19 and a LC amino acid sequence of SEQ ID NO: 20 and a TIGIT antigen binding protein comprising a HC amino acid sequence of SEQ ID NO: 219 and a LC amino acid sequence of SEQ ID NO: 220, (K) a CD112R antigen binding protein comprising a HC amino acid sequence of SEQ ID NO: 39 and a LC amino acid sequence of SEQ ID NO: 40 and a TIGIT antigen binding protein comprising a HC amino acid sequence of SEQ ID NO: 219 and a LC amino acid sequence of SEQ ID NO: 220, (L) a CD112R antigen binding protein comprising a HC amino acid sequence of SEQ ID NO: 39 and a LC amino acid sequence of SEQ ID NO: 40 and a TIGIT antigen binding protein comprising a HC amino acid sequence of SEQ ID NO: 169 and a LC amino acid sequence of SEQ ID NO: 170, (M) a CD112R antigen binding protein comprising a HC amino acid sequence of SEQ ID NO: 29 and a LC amino acid sequence of SEQ ID NO: 30 and a TIGIT antigen binding protein comprising a HC amino acid sequence of SEQ ID NO: 169 and a LC amino acid sequence of SEQ ID NO: 170, or (N) a CD112R antigen binding protein comprising a HC amino acid sequence of SEQ ID NO: 99 and a LC amino acid sequence of SEQ ID NO: 100 and a TIGIT antigen binding protein comprising a HC amino acid sequence of SEQ ID NO: 169 and a LC amino acid sequence of SEQ ID NO: 170.

16. The composition of claim 13, wherein the CD112R antigen binding protein and the TIGIT antigen binding protein are present in the composition at a ratio of about 1:1.

17. The composition of claim 13 further comprising a PD-1 antigen binding protein.

18. A kit comprising TIGIT antigen-binding protein of claim 7 and a container.

19. A pharmaceutical composition comprising a TIGIT antigen-binding protein of claim 7 and a pharmaceutically acceptable carrier, excipient, or diluent.

20. A method of treating a solid tumor or cancer in a subject comprising administering to the subject a first pharmaceutical composition comprising a CD112R antigen-binding protein and a TIGIT antigen-binding protein and a second pharmaceutical composition comprising a PD-1 inhibitor, wherein the first pharmaceutical composition comprises the composition of claim 13.

21. A pharmaceutical composition comprising a CD112R antigen-binding protein of claim 1 and a pharmaceutically acceptable carrier, excipient, or diluent.

22. A kit comprising a CD112R antigen-binding protein of claim 1 and a container.

23. An anti-CD112R antibody comprising a heavy chain (HC) CDR1, HC CDR2, HC CDR3, light chain (LC) CDR1, LC CDR2, and LC CDR3 comprising the amino acid sequences of SEQ ID NOs: 33-38, respectively.

24. The anti-CD112R antibody of claim 23, comprising a HC variable region amino acid sequence of SEQ ID NO: 31 and a LC variable region amino acid sequence of SEQ ID NO: 32.

25. The anti-CD112R antibody of claim 24, comprising a FL HC amino acid sequence of SEQ ID NO: 29 and a FL LC amino acid sequence of SEQ ID NO: 30.

26. An anti-TIGIT antibody comprising a heavy chain (HC) CDR1, HC CDR2, HC CDR3, light chain (LC) CDR1, LC CDR2, and LC CDR3 comprising the amino acid sequences of SEQ ID NOs: 203-208, respectively.

27. The anti-TIGIT antibody of claim 26, comprising a HC variable region amino acid sequence of SEQ ID NO: 201 and a LC variable region amino acid sequence of SEQ ID NO: 202.

28. The anti-TIGIT antibody of claim 27, comprising a FL HC amino acid sequence of SEQ ID NO: 199 and FL LC amino acid sequence of SEQ ID NO: 200.

29. The composition of claim 14, wherein the CD112R antigen binding protein comprises (i) a HC amino acid sequence of SEQ ID NO: 29 and a LC amino acid sequence of SEQ ID NO: 30, (ii) a HC amino acid sequence of SEQ ID NO: 59 and a LC amino acid sequence of SEQ ID NO:

60, or (iii) a HC amino acid sequence of SEQ ID NO: 79 and a LC amino acid sequence of SEQ ID NO: 80 and/or the TIGIT antigen binding protein comprises a HC amino acid sequence of SEQ ID NO: 199 and a LC amino acid sequence of SEQ ID NO: 200 or a HC amino acid sequence of SEQ ID NO: 219 and a LC amino acid sequence of SEQ ID NO: 220.

30. The CD112R antigen-binding protein of claim 6, wherein the antibody protein product is an scFv.

31. The TIGIT antigen-binding protein of claim 12, wherein the antibody protein product is an scFv.

32. A nucleic acid encoding the CD112R antigen binding protein of claim 1.

33. A nucleic acid encoding (i) a HC variable region comprising an amino acid sequence selected from the group consisting of SEQ ID NOs: 11, 21, 31, 41, 51, 61, 71, 81, 91, 101, 231, 1971, 1981, 1991, and 2001, or an amino acid sequence having at least 90% sequence identity to one of SEQ ID NOs: 11, 21, 31, 41, 51, 61, 71, 81, 91, 101, 231, 1971, 1981, 1991, and 2001, (ii) a LC variable region comprising an amino acid sequence selected from the group consisting of SEQ ID NOs: 12, 22, 32, 42, 52, 62, 72, 82, 92, 102, 232, 1972, 1982, 1992, and 2002, or an amino acid sequence having at least 90% sequence identity to one of SEQ ID NOs: 12, 22, 32, 42, 52, 62, 72, 82, 92, 102, 232, 1972, 1982, 1992, and 2002, or (iii) both (i) and (ii).

34. A vector comprising one or more nucleic acids of claim 32.

35. A host cell comprising one or more nucleic acids of claim 32.

36. A nucleic acid encoding the TIGIT antigen binding protein of claim 4.

37. A nucleic acid encoding (i) a HC variable region comprising an amino acid sequence selected from the group consisting of SEQ ID NOs: 111, 121, 131, 141, 151, 161, 171, 181, 181, 191, 201, 211, 221, and 2011, or an amino acid sequence having at least 90% sequence identity to one of SEQ ID NOs: 111, 121, 131, 141, 151, 161, 171, 181, 181, 191, 201, 211, 221, and 2011, (ii) a LC variable region comprising an amino acid sequence selected from the group consisting of SEQ ID NOs: 112, 122, 132, 142, 152, 162, 172, 182, 192, 202, 212, 222, and 2012, or an amino acid sequence having at least 90% sequence identity to any one of SEQ ID NOs: 112, 122, 132, 142, 152, 162, 172, 182, 192, 202, 212, 222, and 2012, or (iii) both (i) and (ii).

38. A vector comprising one or more nucleic acids of claim 37.

39. A host cell comprising one or more nucleic acids of claim 32.

40. A method of making a CD112R antigen-binding protein comprising culturing the host cell of claim 35 so as to express the CD112R antigen-binding protein and harvesting the expressed CD112R antigen-binding protein.

41. A method of making a TIGIT antigen-binding protein comprising culturing the host cell of claim 39 so as to express the TIGIT antigen-binding protein and harvesting the expressed TIGIT antigen-binding protein.

* * * * *